(12) United States Patent
Douchin et al.

(10) Patent No.: US 10,837,041 B2
(45) Date of Patent: Nov. 17, 2020

(54) PRODUCTION OF STEVIOL GLYCOSIDES IN RECOMBINANT HOSTS

(71) Applicant: Evolva SA, Reinach (CH)

(72) Inventors: Veronique Douchin, Frederiksberg (DK); Michael Dalgaard Mikkelsen, Vaerlose (DK); Iben Møller-Hansen, Frederiksberg (DK)

(73) Assignee: EVOLVA SA, Reinach (CH)

( * ) Notice: Subject to any disclaimer, the term of this patent is extended or adjusted under 35 U.S.C. 154(b) by 0 days.

(21) Appl. No.: 15/746,252

(22) PCT Filed: Jul. 29, 2016

(86) PCT No.: PCT/EP2016/068259
§ 371 (c)(1),
(2) Date: Jan. 19, 2018

(87) PCT Pub. No.: WO2017/025362
PCT Pub. Date: Feb. 16, 2017

(65) Prior Publication Data
US 2018/0282776 A1 Oct. 4, 2018

Related U.S. Application Data

(60) Provisional application No. 62/202,620, filed on Aug. 7, 2015.

(51) Int. Cl.
| | |
|---|---|
| C12P 21/06 | (2006.01) |
| C12P 19/56 | (2006.01) |
| C07K 14/245 | (2006.01) |
| A23L 27/30 | (2016.01) |
| C07H 3/06 | (2006.01) |
| C12N 15/74 | (2006.01) |
| C12N 15/81 | (2006.01) |
| C12N 15/82 | (2006.01) |
| C12N 9/06 | (2006.01) |
| C12N 9/02 | (2006.01) |

(52) U.S. Cl.
CPC .............. *C12P 19/56* (2013.01); *A23L 27/36* (2016.08); *C07H 3/06* (2013.01); *C07K 14/245* (2013.01); *C12N 15/746* (2013.01); *C12N 15/81* (2013.01); *C12N 15/8243* (2013.01); *C12N 15/8257* (2013.01); *C12N 9/0032* (2013.01); *C12N 9/0073* (2013.01)

(58) Field of Classification Search
None
See application file for complete search history.

(56) References Cited

U.S. PATENT DOCUMENTS

| | | |
|---|---|---|
| 4,590,160 A | 5/1986 | Nishihashi et al. |
| 5,204,253 A | 4/1993 | Sanford et al. |
| 5,306,862 A | 4/1994 | Chappell et al. |
| 5,460,949 A | 10/1995 | Saunders et al. |
| 5,538,880 A | 7/1996 | Lundquist et al. |
| 6,013,863 A | 1/2000 | Lundquist et al. |
| 6,215,051 B1 | 4/2001 | Yu et al. |
| 6,255,557 B1 | 7/2001 | Brandle |
| 6,284,493 B1 | 9/2001 | Roth |
| 6,284,506 B1 | 9/2001 | Hoshino et al. |
| 6,329,571 B1 | 12/2001 | Hiei |
| 6,586,202 B2 | 7/2003 | Hoshino et al. |
| 6,660,507 B2 | 12/2003 | Cheng et al. |
| 6,806,076 B1 | 10/2004 | Miyake et al. |
| 6,969,595 B2 | 11/2005 | Brzostowicz et al. |
| 7,034,140 B2 | 4/2006 | Bramucci et al. |
| 7,056,717 B2 | 6/2006 | Cheng et al. |
| 7,098,000 B2 | 8/2006 | Cheng et al. |
| 7,129,392 B2 | 10/2006 | Hahn et al. |
| 7,132,268 B2 | 11/2006 | Miyake et al. |
| 7,172,886 B2 | 2/2007 | Keasling et al. |
| 7,183,089 B2 | 2/2007 | Keasling et al. |
| 7,186,891 B1 | 3/2007 | Chappell et al. |
| 7,208,298 B2 | 4/2007 | Miyake et al. |
| 7,335,815 B2 | 2/2008 | Boronat et al. |
| 7,364,885 B2 | 4/2008 | Miyake et al. |
| 7,422,884 B2 | 9/2008 | Bai et al. |
| 7,514,597 B2 | 4/2009 | Nakamura et al. |
| 7,569,389 B2 | 9/2009 | Feldmann et al. |
| 7,692,065 B2 | 4/2010 | Harper et al. |
| 7,838,287 B2 | 11/2010 | Goldsmith et al. |
| 7,923,541 B2 | 4/2011 | Yang et al. |
| 7,927,851 B2 | 4/2011 | Brandle et al. |
| 7,981,647 B2 * | 7/2011 | Berry ...................... C12N 1/20 435/161 |
| 9,562,251 B2 | 2/2017 | Kishore et al. |
| 9,957,540 B2 | 5/2018 | Mikkelsen et al. |

(Continued)

FOREIGN PATENT DOCUMENTS

| | | |
|---|---|---|
| CN | 101720910 | 6/2010 |
| CN | 102216313 | 10/2011 |

(Continued)

OTHER PUBLICATIONS

Rudinger et al. (Jun. 1976. Peptide Hormones. Biol.Council. pp. 5-7).*
Mikayama et al. (Nov. 1993. Proc.Natl.Acad.Sci. USA, vol. 90 : 10056-10060.*
Jewett et al. "An integrated cell-free metabolic platform for protein production and synthetic biology," Mol Syst Biol. 4:220 (2008).

(Continued)

*Primary Examiner* — Jennifer E Graser
(74) *Attorney, Agent, or Firm* — McDonnell Boehnen Hulbert & Berghoff LLP

(57) ABSTRACT

The invention relates to recombinant microorganisms and methods for producing steviol glycosides and steviol glycoside precursors.

28 Claims, 15 Drawing Sheets

Specification includes a Sequence Listing.

(56) References Cited

U.S. PATENT DOCUMENTS

| | | |
|---|---|---|
| 2002/0142408 A1 | 10/2002 | DiCosimo et al. |
| 2003/0033626 A1 | 2/2003 | Hahn et al. |
| 2003/0148416 A1 | 8/2003 | Berry et al. |
| 2003/0148479 A1 | 8/2003 | Keasling et al. |
| 2003/0190734 A1 | 10/2003 | Hoshino et al. |
| 2003/0219798 A1 | 11/2003 | Gokarn et al. |
| 2004/0010815 A1 | 1/2004 | Lange et al. |
| 2004/0072311 A1 | 4/2004 | DiCosimo et al. |
| 2004/0078846 A1 | 4/2004 | Desouza et al. |
| 2004/0176570 A1 | 9/2004 | Bacher et al. |
| 2004/0194162 A1 | 9/2004 | Hahn et al. |
| 2005/0003474 A1 | 1/2005 | Desouza |
| 2005/0032169 A1 | 2/2005 | Miyake et al. |
| 2006/0014264 A1 | 1/2006 | Sauer |
| 2006/0079476 A1 | 4/2006 | Keasling et al. |
| 2006/0083838 A1 | 4/2006 | Jackson et al. |
| 2007/0004000 A1 | 1/2007 | Miyake et al. |
| 2007/0077616 A1 | 4/2007 | Keasling et al. |
| 2007/0099261 A1 | 5/2007 | Keasling et al. |
| 2007/0118916 A1 | 5/2007 | Puzio et al. |
| 2007/0128311 A1 | 6/2007 | Prakash et al. |
| 2007/0166782 A1 | 7/2007 | Keasling et al. |
| 2007/0202579 A1 | 8/2007 | Berry et al. |
| 2007/0238157 A1 | 10/2007 | Millis et al. |
| 2007/0238159 A1 | 10/2007 | Millis et al. |
| 2007/0238160 A1 | 10/2007 | Millis et al. |
| 2007/0254354 A1 | 11/2007 | Millis et al. |
| 2007/0269857 A1 | 11/2007 | Miyake et al. |
| 2007/0286850 A1 | 12/2007 | Bai et al. |
| 2008/0064063 A1 | 3/2008 | Brandle |
| 2008/0081358 A1 | 4/2008 | Vittanen et al. |
| 2008/0131926 A1 | 6/2008 | Miyake et al. |
| 2008/0261280 A1 | 10/2008 | Hahn et al. |
| 2008/0271205 A1 | 10/2008 | Yamaguchi et al. |
| 2008/0286870 A1 | 11/2008 | Vittanen et al. |
| 2008/0292775 A1 | 11/2008 | Prakash et al. |
| 2008/0318227 A1 | 12/2008 | Bacher et al. |
| 2009/0004724 A1 | 1/2009 | Keasling et al. |
| 2009/0047718 A1 | 2/2009 | Blaschek et al. |
| 2009/0055974 A1 | 2/2009 | Tanksley et al. |
| 2009/0074935 A1 | 3/2009 | Lee |
| 2009/0143308 A1 | 6/2009 | Monk et al. |
| 2009/0286262 A1 | 11/2009 | Slack |
| 2009/0298706 A1 | 12/2009 | Lee et al. |
| 2010/0112156 A1 | 5/2010 | Abelyan et al. |
| 2010/0120096 A1 | 5/2010 | Kitaoka et al. |
| 2010/0221801 A1 | 9/2010 | Van Dyk |
| 2010/0297722 A1 | 11/2010 | Anterola et al. |
| 2010/0316782 A1 | 12/2010 | Shi et al. |
| 2011/0087011 A1 | 4/2011 | Chiang et al. |
| 2011/0092684 A1 | 4/2011 | Abelyan et al. |
| 2011/0126318 A1 | 5/2011 | Allen et al. |
| 2011/0160311 A1 | 6/2011 | Prakash et al. |
| 2012/0021111 A1 | 1/2012 | Pfister et al. |
| 2012/0083593 A1 | 4/2012 | Liu et al. |
| 2012/0164678 A1 | 6/2012 | Stephanopoulos et al. |
| 2012/0178169 A1 | 7/2012 | Voytas et al. |
| 2013/0137138 A1 | 5/2013 | Hansen |
| 2013/0171328 A1 | 7/2013 | Kishore et al. |
| 2014/0329281 A1 | 11/2014 | Houghton-Larsen et al. |
| 2015/0159188 A1 | 6/2015 | Ono et al. |
| 2015/0342234 A1 | 12/2015 | Hicks et al. |
| 2016/0186225 A1 | 6/2016 | Mikkelsen et al. |

FOREIGN PATENT DOCUMENTS

| | | |
|---|---|---|
| CN | 103397064 | 11/2013 |
| CN | 104845990 | 8/2015 |
| EP | 0955363 | 11/1999 |
| EP | 1072683 | 1/2001 |
| EP | 1171610 | 4/2007 |
| EP | 1198575 | 9/2007 |
| EP | 1383864 | 1/2008 |
| EP | 1897951 | 3/2008 |
| EP | 1947189 | 7/2008 |
| EP | 1392824 | 8/2008 |
| EP | 2575432 | 4/2013 |
| EP | 2902410 | 8/2015 |
| JP | 5910-001408 | 6/1984 |
| JP | 3-277275 | 12/1991 |
| JP | 05-115298 | 5/1993 |
| JP | 2009034080 | 2/2009 |
| KR | 1020120088035 | 8/2012 |
| KR | 20150000258 | 1/2015 |
| WO | WO 1999/018224 | 4/1999 |
| WO | WO 2000/036081 | 6/2000 |
| WO | WO 2000/037663 | 6/2000 |
| WO | WO 2000/063400 | 10/2000 |
| WO | WO 2001/012828 | 11/2001 |
| WO | WO 2001/083769 | 11/2001 |
| WO | WO 2001/094561 | 12/2001 |
| WO | 2002/024865 | 3/2002 |
| WO | WO 2002/020728 | 3/2002 |
| WO | WO 2002/020815 | 3/2002 |
| WO | WO 2003/008540 | 1/2003 |
| WO | WO 2002/055709 | 7/2003 |
| WO | WO 2004/029255 | 4/2004 |
| WO | WO 2005/079183 | 9/2005 |
| WO | WO 2006/016395 | 2/2006 |
| WO | WO 2006069610 | 7/2006 |
| WO | WO 2006/093289 | 9/2006 |
| WO | WO 2006/096392 | 9/2006 |
| WO | WO 2007/136847 | 11/2007 |
| WO | WO 2008/008256 | 1/2008 |
| WO | WO 2008/034648 | 3/2008 |
| WO | WO 2008/039499 | 4/2008 |
| WO | WO 2008/051349 | 5/2008 |
| WO | WO 2008/091547 | 7/2008 |
| WO | WO 2009/005704 | 1/2009 |
| WO | WO 2009/037329 | 3/2009 |
| WO | WO 2009/071277 | 6/2009 |
| WO | WO 2009/086049 | 7/2009 |
| WO | WO 2009/105612 | 8/2009 |
| WO | WO 2009/108680 | 9/2009 |
| WO | 2009/140394 | 11/2009 |
| WO | WO 2009/111513 | * 11/2009 |
| WO | WO 2009/140394 | 11/2009 |
| WO | WO 2010/021001 | 2/2010 |
| WO | WO 2010/038911 | 4/2010 |
| WO | WO 2010/044960 | * 4/2010 |
| WO | 2010/142305 | 12/2010 |
| WO | WO 2010/146463 | 12/2010 |
| WO | WO 2011/028671 | 3/2011 |
| WO | WO 2011/037959 | 3/2011 |
| WO | WO 2011/046423 | 4/2011 |
| WO | WO 2011/056834 | 5/2011 |
| WO | WO 2011/060057 | 5/2011 |
| WO | WO 2011/153378 | 8/2011 |
| WO | 20111140329 | 11/2011 |
| WO | 2011/151326 | 12/2011 |
| WO | 2011/153378 | 12/2011 |
| WO | WO 2011/151326 | 12/2011 |
| WO | WO 2011/153144 | 12/2011 |
| WO | WO 2012/075030 | 6/2012 |
| WO | 2013/022989 | 2/2013 |
| WO | WO 2013/019050 | 2/2013 |
| WO | WO 2013/022989 | 2/2013 |
| WO | WO 2013/021261 | 5/2013 |
| WO | WO 2013/076577 | 5/2013 |
| WO | WO 2013/096420 | 6/2013 |
| WO | WO 2013/102793 | 7/2013 |
| WO | WO 2013/110673 | 8/2013 |
| WO | WO 2013/176738 | 11/2013 |
| WO | WO 2014/086890 | 6/2014 |
| WO | WO 2014/122227 | 8/2014 |
| WO | WO 2014/122328 | 8/2014 |
| WO | 2014/191580 | 12/2014 |
| WO | 2014/191581 | 12/2014 |
| WO | 20151011209 | 1/2015 |
| WO | WO 2015007748 | 1/2015 |
| WO | 2015/014959 | 2/2015 |
| WO | 2015/016393 | 2/2015 |
| WO | WO 2015/014969 | 2/2015 |
| WO | WO 2015/028324 | 3/2015 |

(56) References Cited

FOREIGN PATENT DOCUMENTS

| | | |
|---|---|---|
| WO | WO 2015051454 | 4/2015 |
| WO | WO 2015/132411 | 9/2015 |
| WO | 2016/023844 | 2/2016 |
| WO | WO 2016/038095 | 3/2016 |
| WO | WO 2016/120486 | 8/2016 |
| WO | 2017/025362 | 2/2017 |

OTHER PUBLICATIONS

Johnstone et al., "Cloning an Aspergillus nidulans developmental gene by transformation," EMBO J. 4(5):1307-11 (1985).
Khoury et al., "Computational design of Candida boidinii xylose reductase for altered cofactor specificity," Protein Sci. 18(10):2125-38 (Oct. 2009).
Kim et al., "Hydroxylation of ent-Kaurenoic Acid to Steviol in Stevia rebaudiana Bertoni-Purification and Partial Characterization of the Enzyme," Arch Biochem Biophys. 332(2):223-30 (1996).
Kim & Shibata, "Characterization of ent-kaurenoic acid 13-hydroxylase in steviol biosynthesis of Stevia rebaudiana Bertoni," Journal of the Korean Agriculturalchemical Society 40(6):501-7 (1997).
Knowles et al., "Genetic Transformation and Plant Regeneration in Stevia rebaudiana Using Microprojectile Bombardment," In Vitro Cellular & Developmental Biology 39(abstract):23-A (2003).
Kohda et al., "New Sweet Diterpene glucoside from Stevia Rebaudiana," Phytochemistry 15(6):981-3 (1976).
Kondo et al., "Preparation of high activity whole cell biocatalyst by permeabilization of recombinant flocculent yeast with alcohol," Enzyme Microb Technol. 27(10),806-11 (2000).
Kumar et al., "A comprehensive analysis of fifteen genes of steviol glycosides biosynthesis pathway in Stevia rebaudiana (Bertoni)," Gene 492:276-84 (Epub Oct. 20, 2011).
Kusama et al., "Transglucosylation into stevioside by the enzyme system from Streptomyces sp.," Agric. Biol. Chem. 50(10):2445-51 (Oct. 1986).
Li et al., "Crystal structure of Medicago truncatula UGT85H2—insights into the structural basis of a multifunctional (iso) flavonoid glycosyltransferase," J Mol Biol. 370(5):951-63 (2007).
Li et al., "Systematic Mutational Analysis of Peptide Inhibition of the p53-MDM2/MDMX," J Mol Biol. 398(2):200-13 (2010).
Li et al., "High-density cultivation of oleaginous yeast Rhodosporidium toruloides Y4 in fed-batch culture," Enzyme and Microbial Technology 41(3):312-7 (Aug. 2007).
Liu et al., "Preparation of high-activity whole cell biocatalysts by permeabilization of recombinant yeasts with alcohol," J Biosci Bioeng 89(6):554-8 (2000).
Ma et al., "Molecular cloning and characterization of Stevia Rebaudiana UDP-glucosyltransferase," Acta Biologiae Experimentalis Sinica 36(2):123-9 (2003).
Ma "Part 1. Molecular Cloning and Functional Analysis of UDPG Glucosyltransferase Gene. Part 2. Molecular Cloning, Sequence Analysis and Evolution of Actin and EF1a Genes in Stevia Rebaudiana." Chinese Doctor and Master Dissertations Full-Text Database, Agricultural Technology Part, vol. 2; pp. 1-74 (2004).
Madan et al., "Stevia rebaudiana (Bert.) Bertoni-A Review," Indian Journal of Natural Products and Resources 1 (3)267-86 (2010).
Madhav et al., "Functional and structural variation of uridine diphosphate glycosyltransferase (UGT) gene of Stevia rebaudiana—UGTSr involved in the synthesis of rebaudioside A," Plant Physiol. Biochem. 63:245-53 (Feb. 2013).
Malonek et al., "The NADPH-cytochrome P450 Reductase Gene from Gibberalla fujikuroi is Essential for Gibberellin Biosynthesis," J Bio Chem. 279(24):25075-84 (2004).
Mantovaneli et al., "The effect of temperature and flow rate on the clarification of the aqueous stevia-extract in a fixed-bed column with zeolites," Braz J Chem Eng. 21(3):449-58 (2004).
Mattanovich et al., "Recombinant protein production in yeasts," Methods Mol Biol. 824:329-58 (2012).
Megeji et al., "Introducing Stevia rebaudiana, a natural zero-calorie sweetener," Current Science 88(5):801-4 (2005).
Mohamed et al., "UDP-dependent glycosyltransferases involved in the biosynthesis of steviol glycosides" Journal of Plant Physiology 168(10):1136-1141 (Jul. 2011; Epub Apr. 7, 2011).
Mumberg et al., "Yeast vectors for the controlled expression of heterologous proteins in different genetic Backgrounds," Gene 156(1):119-22 (1995).
Naesby et al., "Yeast artificial chromosomes employed for random assembly of biosynthetic pathways and production of diverse compounds in Saccharomyces cerevisiae," Microb Cell Fact. 8:45 (2009).
Naglak & Wang, "Rapid protein release from Escherichia coil by chemical permeabilization under fermentation conditions," Biotechnol Bioeng. 39(7):732-40 (1991).
Nakagiri et al., "cDNA cloning, functional expression and characterization of ent-copalyl diphosphate synthase from Scoparia dulcis L.," Plant Sci. 169:760-7 (2005).
Nelson et al., "P450 superfamily: update on new sequences, gene mapping, accession numners and nomenclature," Pharmacogenetics 6:1-42 (1996).
Newman et al., "High-level production of amorpha-4,11-diene in a two-phase partitioning bioreactor of metabolically engineered Escherichia coli," Biotechnol Bioeng 95(4):684-91 (2006).
Nicaud, "Yarrowia lipolytica," Yeast 29(10):409-18 (Oct. 2012).
Nielsen et al., "Efficient PCR-based gene targeting with a recyclable marker for Aspergillus nidulans," Fungal Genet Biol. 43(1):54-64 (2006).
Nour-Eldin et al., "User cloning and User fusion: the ideal cloning techniques for small and big laboratories," Methods Mol Biol. 643:185-200 (2010).
Ohta et al., "Characterization of Novel Steviol Glycosides from Leaves of Stevia rebaudiana Morita," J. Applied Glycosides 57(3):199-209 (Mar. 2010).
Ohta et al., MassBank Accession No. FU000341 (May 2011).
Ohta et al., MassBank Accession No. FU000342 (May 2011).
Ohta et al., MassBank Accession No. FU000343 (May 2011).
Ohtani et al., "Further Study on the 1,4-alpha-Transglucosylation of Rubusoside, a Sweet Steviol-Bisglucoside from Rubus suavissimus," Agric Biol Chem. 55(2):449-53 (1991).
Oka & Jigami, "Reconstruction of de novo pathway for synthesis of UDP-glucuronic acid and UDP-xylose from intrinsic UDP-glucose in Saccharomyces cerevisiae," FEBS J. 273(12):2645-57 (2006).
Orihara et al., "Biotransformation of steviol by cultured cells of eucalyptus perriniana and Coffea Arabica," Phytochemistry 30(12):3989-92 (1991).
Paradise et al., "Redirection of flux through the FPP branch-point in Saccharomyces cerevisiae by down-regulating squalene synthase," Biotechnol Bioeng. 100(2):371-8 (2008).
Pearson & Lipman, "Improved tools for biological sequence comparison," Proc Natl Acad Sci. 85(8):2444-8 (1998).
Piirainen et al., "Glycoengineering of yeasts from the perspective of glycosylation efficiency," N Biotechnol. 31 (6):532-7 (Dec. 2014).
Pompon et al., "Yeast Expression of Animal and Plant P450s in Optimized RedoxEnvironments," Methods Enzymol 272:51-64 (1996).
Prelich, "Gene overexpression: uses, mechanisms, and interpretation," Genetics 190(3):841-54 (Mar. 2012).
Presecki & Vasic-Racki, "Production of L-malic acid by permeabilized cells of commercial Saccharomyces sp. strains," Biotechnol Lett. 27(23-24):1835-9 (2005).
Ro et al., "Production of the antimalarial drug precursor artemisinic acid in engineered yeast," Nature 440(7086):940-3 (2006).
Saenge et al., "Potential use of oleaginous red yeast Rhodotorula glutinis for the bioconversion of crude glycerol from biodiesel plant to lipids and carotenoids," Process Biochemistry 46(1):210-8 (Jan. 2011).
Schwab et al., Poster, "Watchmakers®-Compound Generation by Combinatorial Genetics and Screening in Yeast," 141st Annual Conference in St. Louis, 2008, 1 page.
Sen et al., "Developments in Directed Evolution for Improving Enzyme Functions," Appl Biochem Biotechnol.143 (3):212-23 (2007).
Senthilraja et al., "RNA secondary structure prediction: Analysis of Saccharomyces cerevisiae RNAs," Int. J. Pharm. Rev. Res. 25(2):287-91 (Mar.-Apr. 2014).

(56) References Cited

OTHER PUBLICATIONS

International Preliminary Report on Patentability from the International Bureau for International Application PCT/EP2015/070620; dated Mar. 14, 2017 (pp. 1-25).
International Preliminary Report on Patentability from the International Bureau for International Application PCT/EP2015/052007; dated Aug. 1, 2017 (pp. 1-16).
International Preliminary Report on Patentability from the International Bureau for International Application PCT/EP2016/068259; dated Feb. 13, 2018 (pp. 1-11).
International Search Report issued by the International Searching Authority for International Application No. PCT/US2011/038967, dated Sep. 1, 2011 (10 pages).
Written Opinion of the International Searching Authority for International Application No. PCT/US2011/038967, dated Sep. 1, 2011 (12 pages).
International Preliminary Report on Patentability issued by the International Bureau for International Application No. PCT/US2011/038967, dated Dec. 4, 2012 (13 pages).
Third-Party Submission under 37 CFR 1.290 for U.S. Appl. No. 13/701,406, dated Mar. 7, 2014 (238 pages).
Extended European Search Report and Opinion issued by the European Patent Office for European Application No. 11790428.4, dated Dec. 20, 2013.
Search Report issued by the Intellectual Property Office of Singapore for Singaporean Application No. 201208854-8, dated Nov. 3, 2014.
Non-Final Office Action for U.S. Appl. No. 14/237,540, dated Dec. 30, 2015 (pp. 1-19).
Final Office Action issued in U.S. Appl. No. 14/237,540; dated Jul. 8, 2016, pp. 1-19.
International Search Report issued by the International Searching Authority for International Application No. PCT/US2012/050021, dated Apr. 12, 2013.
Written Opinion of the International Searching Authority for International Application No. PCT/US2012/050021, dated Apr. 12, 2013.
International Preliminary Report on Patentability issued by the International Bureau for International Application No. PCT/US2012/050021, dated Feb. 11, 2014.
Extended European Search Report issued in EP 15193074.0; dated Feb. 12, 2016, pp. 1-9.
International Search Report from the International Searching Authority for International Application No. PCT/EP2014/052363, dated Sep. 22, 2014 (12 pages).
Witten Opinion of the International Searching Authority for International Application No. PCT/EP2014/052363, dated Sep. 22, 2014 (10 pages).
International Preliminary Report on Patentability issued by the International Bureau for International Application No. PCT/EP2014/052363, dated Aug. 11, 2015. (11 pages).
International Preliminary Report on Patentability issued by the International Bureau for International Application No. PCT/EP2014/052675, dated Aug. 11, 2015 (8 pages).
International Search Report of the International Searching Authority for International Application No. PCT/EP2013/075587, dated Feb. 20, 2014 (pp. 1-5).
Witten Opinion of the International Searching Authority for International Application No. PCT/EP2013/075587, dated Feb. 20, 2014 (pp. 1-9).
International Preliminary Report on Patentability from the International Bureau for International Application No. PCT/EP2013/075587, dated Jun. 9, 2015 (pp. 1-10).
Third Party Submission in U.S. Appl. No. 14/648,747; dated Mar. 28, 2016, pp. 1-231.
Invitation to Pay Additional Fees and, Where Applicable, Protest Fee by the International Searching Authority for International Application No. PCT/EP2015/070620, dated Nov. 27, 2015 (pp. 1-14).
International Search Report by the International Searching Authority for International Application No. PCT/EP2015/070620; dated Mar. 29, 2016, pp. 1-10.
Written Opinion of the International Searching Authority for International Application No. PCT/EP2015/070620; dated Mar. 29, 2016, pp. 1-24.
International Search Report and Written Opinion of the International Searching Authority for International Application No. PCT/EP2015/068314, dated Jan. 20, 2016 (pp. 1-7).
Written Opinion of the International Searching Authority for International Application No. PCT/EP2015/068314, dated Jan. 20, 2016 (pp. 1-9).
International Search Report and Written Opinion of the International Searching Authority for International Application No. PCT/EP2015/052007; dated Jul. 4, 2016, pp. 1-24.
Abraham & Bhat, "Permeabilization of bakers yeast with N-lauroyl sarcosine," J Ind Microbial Biotechnol. 35 (8):799-804 (2008).
Ageitos et al., "Oily yeasts as oleaginous cell factories," Appl Microbiol Biotechnol. 90(4):1219-27 (May 2011).
Agrawal, "NMR spectroscopy in the structural elucidation of oligosaccharides and glycosides," Phytochemistry 31 (10):3307-30 (1992).
Ajikumar et al., "Terpenoids: opportunities for biosynthesis of natural product drugs using engineered microorganisms," Molecular Pharmaceuticals 5(2):167-90 (2008).
Alakomi et al., "Lactic acid permeabilizes gram-negative bacteria by disrupting the outer membrane," Appl Environ Microbiol. 66(5):2001-5 (2000).
Ali et al., "Biochemical investigation during different stages of in vitro propagation of Stevia rebaudiana," Pak J Bot. 42 (4):2827-37 (2010).
Bankar et al., "Environmental and industrial applications of Yarrowia lipolytica," Appl Microbiol Biotechnol. 84 (5):847-65 (Oct. 2009).
Baykov et al., "A malachite green procedure for orthophosphate determination and its use in alkaline phosphatase-based enzyme immunoassay," Anal Biochem. 171(2):266-70 (Jun. 1988).
Beopoulos et al., "Yarrowia lipolytica: A model and a tool to understand the mechanisms implicated in lipid accumulation," Biochimie 91(6):692-6 (Jun. 2009).
Brandle et al., "Leaf ESTs from Stevia rebaudiana: A Resource for Gene Discovery in Diterpene Synthesis," Plant Mol Biol. 50(4-5):613-22 (2002).
Brandle & Telmer, "Steviol glycoside biosynthesis," Phytochemistry 68(14):1855-63 (2007).
Brochado et al. "Improved vanillin production in baker's yeast through in silico design," Microb Cell Fact. 9:84-98 (2010).
Carretero-Paulet et al., "Expression and Molecular Analysis of the Arabidopsis DXR Gene Encoding 1-Deoxy-d-Xylulose 5-Phosphate Reductoisomerase, the First Committed Enzyme of the 2-C-Methyl-D-Erythritol 4-Phosphate Pathway," Plant Physiol. 129(4):1581-91 (2002).
Ceunen & Geuns, "Steviol glycosides: chemical diversity, metabolism, and function," J. Nat. Prod. 76(6):1201-28 (Jun. 2013).
Chemler et al., "Biosynthesis of isoprenoids, polyunsaturated fatty acids and flavonoids in *Saccharomyces cerevisiae*," Microb Cell Fact. 5:20 (2006).
Chen et al., "MolProbity: all-atom structure validation for macromolecular crystallography," Acta Crystallogr D Biol Crystallogr 66(Pt 1):12-21 (Jan. 2010).
Chica et al., "Semi-rational approaches to engineering enzyme activity: combining the benefits of directed evolution and rational design," Curr Opin Biotechnol.16(4):378-84 (2005).
Chow & Palecek, "Enzyme encapsulation in permeabilized *Saccharomyces cerevisiae* cells," Biotechnol Prog. 20 (2):449-56 (2004).
Correa et al., "Genetic mapping of 1,3-beta-glucanase-encoding genes in *Saccharomyces cerevisiae*," Current Genet. 22(4):283-8 (1992).
Darise et al., "Enzymic Transglucosylation of Rubusoside and the Structure-Sweetness Relationship of Steviol-Bisglycosides," Agric. Biol. Chem. 48(10):2483-8 (Jan. 1984).
Davis et al., "MolProbity: all-atom contacts and structure validation for proteins and nucleic acids," Nucleic Acids Res. 35:W375-83 (Apr. 2007).

(56) References Cited

OTHER PUBLICATIONS

Del Sorbo et al., "Fungal transporters involved in efflux of natural toxic compounds and fungicides," Fungal. Genet. Biol. 30(1):1-15 (Jun. 2000).
Diener et al., "Arabidopsis ALF5, a multidrug efflux transporter gene family member, confers resistance to toxins," Plant Cell 13(7):1625-38 (Jul. 2001).
Dodhia et al., "Engineering human cytochrome P450 enzymes into catalytically self-sufficient chimeras using molecular Lego," J Biol Inorg Chem. 11(7):903-16 (Oct. 2006).
Dubey, et al., An overview of the non-mevalonate pathway for terpenoid biosynthesis in plants, J. Biosci. 28 (5):637-46 (2003).
Dubois & Stephenson, "Diterpenoid sweeteners. Synthesis and sensory evaluation of stevioside analogues with improved organoleptic properties," J. Med. Chem. 28(1):93-8 (Jan. 1985).
EFSA Panel on Food Additives and Nutrient Sources added to Food (ANS), "Scientific Opinion on the safety of steviol glycosides for the proposed uses as a food additive," EFSA Journal 8(4):1537 (2010).
Eisenreich et al., "Biosynthesis of isoprenoids via the non-mevalonate pathway," Cell Mol Life Sci. 61(12):1401-6 (2004).
Emboss Needle results for Pairwise Sequence Alignment of UGT91D1 and UGT91D2; dated Apr. 4, 2016, 2 pages.
Emmerstorfer et al., "Over-expression of ICE2 stabilizes cytochrome P450 reductase in *Saccharomyces cerevisiae* and Pichia pastoris," Biotechnol J. 10(4):623-35 (Apr. 2015).
Estrada De Martin et al., "Ice2p is important for the distribution and structure of the cortical ER network in *Saccharomyces cerevisiae*," J Cell Sci. 118(Pt 1):65-77 (Oct. 2006).
Fernandez et al., "Activation of chitin synthetase in permeabilized cells of a *Saccharomyces cerevisiae* mutant lacking proteinase B," J Bacteriol. 152(3):1255-64 (1982).
Flores et al., "Permeabilization of yeast cells (*Kluyveromyces lactis*) with organic solvents," Enzyme Microb Technol. 16(4):340-6 (1994).
Fowler & Zabin, " Effects of Dimethylsulfoxide on the Lactose Operon in *Escherichia coli*," J Bacteriol. 92(2):353-7 (1966).
Freire, "Differential scanning calorimetry," Methods Mol Biol. 40:191-218 (1995).
Fukunaga et al., "Enzymatic transglucosylation products of stevioside: separation and sweetness-evaluation," Agric. Biol. Chem. 53(6):1603-7 (Jan. 1989).
Geuns, "Stevioside," Phytochemistry 64(5):913-21 (2003).
Giaever & Nislow, "The yeast deletion collection: a decade of functional genomics," Genetics 197(2):451-65 (Jun. 2014).
Getz & Schiestl, "High-efficiency yeast transformation using the LiAc/SS carrier DNA/PEG method," Nat Protoc. 2 (1):31-4 (2007).
Girvan et al., "Flavocytochrome P450 BM3 mutant W1046A is a NADH-dependent fatty acid hydroxylase: implications for the mechanism of electron transfer in the P450 BM3 dimer," Arch Biochem Biophys. 507(1):75-85 (Mar. 2011).
Goralczyk, "Compounds from Stevia for Improving and Maintaining Mental Performance," Stevia World Forum, Feb. 24-25, 2010, 17 pages.
Guleria & Yadav, "Insights into Steviol Glycoside Biosynthesis Pathway Enzymes Through Structural Homology Modeling," Am. J. Biochem. Molec. Biol. 3(1):1-19 (2013).
Gunel et al., "Metabolic Engineering for Production of Geranylgeranyl Pyrophosphate Synthase in Non-Carotenogenic Yeast Schizosaccharomyces Pombe," Biotechnol. & Biotechnol. Eq. 20(3):76-82 (2006).
Hansen et al., "De novo biosynthesis of vanillin in fission yeast (*Schizosaccharomyces pombe*) and baker's yeast (*Saccharomyces cerevisiae*)," Appl Environ Microbiol. 75(9):2765-74 (2009).
Hansen et al., "Versatile Enzyme Expression and Characterization System for Aspergillus nidulans, with the Penicillium brevicompactum Polyketide Synthase Gene from the Mycophenolic Acid Gene Cluster as a Test Case," Appl Environ Microbiol. 77(9):3044-51 (2011).

Hellfritsch et al., "Human psychometric and taste receptor responses to steviol glycosides," J. Agric. Food Chem. 60(27):6782-93 (Jul. 2012).
Humphrey et al., "Spatial organisation of four enzymes from Stevia rebaudiana that are involved in steviol glycoside synthesis," Plant Mol Bio. 61(1-2):47-62 (2006).
Andolino et al., "High-Quality RNA, cDNA, and Derived EST Libraries From Grapevine (*Vitis vinifera* L.)," Plant Mol Biol Reporter 22:269-78 (2004).
Irmler et al., "Indole alkaloid biosynthesis in Catharanthus roseus: new enzyme activities and identification of cytochrome P450 CYP72A1 as secologanin synthase," Plant J. 24(6):797-804 (2000).
Jennewein et al., "Taxol biosythesis: baxane 13 alpha-hydroxylase is a cytochrome P450-dependent monooxygenase," Proc Natl Acad Sci U S A 98(24):13595-600 (2001).
GenBank Accession No. XM_001467423, dated Jul. 16, 2015 (2 pages).
GenBank Accession No. XP_002282091, dated Dec. 7, 2011 (1 page).
GenBank Accession No. XP_002288339, dated Jul. 15, 2009 (2 pages).
GenBank Accession No. XP_002311286, dated Dec. 31, 2013 (2 pages).
GenBank Accession No. ZP_05004570, dated Jun. 8, 2010 (2 pages).
Gossen & Bujard, "Studying gene function in eukaryotes by conditional gene inactivation," Annu. Rev. Genet. 36:153-73 (Jun. 2002).
Gritz & Davies, "Plasmid-encoded hygromycin B resistance: the sequence of hygromycin B phosphotransferase gene and its expression in *Escherichia coli* and *Saccharomyces cerevisiae*," Gene 25(2-3):179-88 (Nov. 1983).
Hallstom & Moye-Rowley, "Divergent transcriptional control of multidrug resistance genes in *Saccharomyces cerevisiae*," J. Biol. Chem. 273(4):2098-104 (Jan. 1998).
Katzmann et al., "Expression of an ATP-binding cassette transporter-encoding gene (YOR1) is required for oligomycin resistance in *Saccharomyces cerevisiae*," Mol. Cell Biol. 15(12):6875-83 (Dec. 1995).
Li et al., "Phylogenetic analysis of the UDP-glycosyltransferase multigene family of *Arabidopsis thaliana*," J. Biol. Chem. 276(6):4338-43 (Oct. 2000).
Masada et al., "An efficient chemoenzymatic production of small molecule glucosides with in situ UDP-glucose recycling," Febs Lett. 581(13):2562-6 (May 2007).
Morita et al., "Japanese morning glory dusky mutants displaying reddish-brown or purplish-gray flowers are deficient in a novel glycosylation enzyme for anthocyanin biosynthesis, UDP-glucose:anthocyanidin 3-O-glucoside-2ᵇ-O-glucosyltransferase, due to 4-bp insertions in the gene," Plant J. 42(3):353-63 (May 2005).
Nagy et al., "Role of the yeast ABC transporter Yor1p in cadmium detoxification," Biochimie 88(11):1665-71 (Jun. 2006).
Nikaido & Takatsuk, "Mechanisms of RND multidrug efflux pumps," Biochim. Biophys. Acta. 1794(5):769-81 (May 2009).
Osmani et al., "Catalytic key amino acids and UDP-sugar donor specificity of a plant glucuronosyltransferase, UGT94B1: molecular modeling substantiated by site-specific mutagenesis and biochemical analyses," Plant Physiol. 148(3):1295-308 (Nov. 2008).
Osmani et al., "Substrate specificity of plant UDP-dependent glycosyltransferases predicted from crystal structures and homology modeling," Phytochemistry 70(3):325-47 (Feb. 2009).
Richman et al., "Functional genomics uncovers three glucosyltransferases involved in the synthesis of the major sweet glucosides of Stevia rebaudiana," Plant J. 41(1):56-67 (Jan. 2005).
Riesmeier et al., "Isolation and characterization of a sucrose carrier cDNA from spinach by functional expression in yeast," EMBO J. 11(13):4705-13 (Dec. 1992).
Rodríguez-Concepción & Boronat, "Elucidation of the methylerythritol phosphate pathway for isoprenoid biosynthesis in bacteria and plastids. A metabolic milestone achieved through genomics," Plant Physiol. 130 (3):1079-89 (Nov. 2002).
Saier Jr et al., "The major facilitator superfamily," J. Mol. Microbiol. Biotechnol. 1(2):257-79 (Nov. 1999).

(56) References Cited

OTHER PUBLICATIONS

Saier Jr et al., "The Transporter Classification Database: recent advances," Nucleic Acids Res. 37:D274-8 (Jan. 2009).
Sauer et al., "The soluble and membrane-bound transhydrogenases UdhA and PntAB have divergent functions in NADPH metabolism of *Escherichia coil*," J. Biol. Chem. 279(8):6613-9 (Dec. 2003).
Sawada et al., "UDP-glucuronic acid:anthocyanin glucuronosyltransferase from red daisy (*Bellis perennis*) flowers. Enzymology and phylogenetics of a novel glucuronosyltransferase involved in flower pigment biosynthesis," J. Biol. Chem. 280(2):899-906 (Jan. 2005).
Shao et al., "Enhanced production of alpha-galactosyl epitopes by metabolically engineered Pichia pastoris," Appl. Environ. Microbiol. 69(9):5238-42 (Sep. 2003).
Son et al., "Production of flavonoid O-glucoside using sucrose synthase and flavonoid 0-glucosyltransferase fusion protein," J. Microbiol. Biotechnol. 19(7):709-12 (Jul. 2009).
Sonnhammer et al., "Pfam: a comprehensive database of protein domain families based on seed alignments," Proteins 28(3):405-20 (Jul. 1997).
Sonnhammer et al., "Pfam: multiple sequence alignments and HMM-protiles of protein domains," Nucleic Acids Res. 26(1):320-2 (Jan. 1998).
Yadav et al., "Steviol Glycosides from Stevia: Biosynthesis Pathway Review and their Application in Foods and Medicine", Critical Reviews in Food Science and Nutrition, vol. 52, No. 11, pp. 988-998; (2012).
International Search Report by the International Searching Authority for International Application No. PCT/EP2014/052675, dated Apr. 23, 2014 (5 pages).
Written Opinion of the International Searching Authority for International Application No. PCT/EP2014/052675, dated Apr. 23, 2014 (7 pages).
Non-Final Office Action for U.S. Appl. No. 14/648,747, dated Mar. 23, 2017 (pp. 1-20).
International Preliminary Report on Patentability from the International Bureau for International Application No. PCT/EP2015/068314, dated Feb. 14, 2017 (pp. 1-10).
International Search Report and Written Opinion of the International Searching Authority for International Application No. PCT/EP2016/080516; dated Mar. 15, 2017, pp. 1-22.
Bateman et al., "Pfam 3.1: 1313 multiple alignments and profile HMMs match the majority of proteins," Nucleic Acids Res. 27(1)260-2 (Jan. 1999).
Bay & Turner, "Diversity and evolution of the small multidrug resistance protein family," BMC Evol. Biol. 9:140 (Jun. 2009).
Brachmann et al., "Designer deletion strains derived from *Saccharomyces cerevisiae* S288C: a useful set of strains and plasmids for PCR-mediated gene disruption and other applications," Yeast 14:115-32 (1998).
Chen et al., "Transferring a biosynthetic cycle into a productive *Escherichia coli* strain: large-scale synthesis of galactosides," J. Am. Chem. Soc. 123(36):8866-7 (Sep. 2001).
Chenna et al., "Multiple sequence alignment with the Clustal series of programs," Nucleic Acids Res. 31 (13):3497-500 (Jul. 2003).
GenBank Accession No. AAB62280, dated Jul. 2, 1997 (2 pages).
GenBank Accession No. AAB87091, dated Mar. 22, 2000 (2 pages).
GenBank Accession No. AAC28895.1, dated Aug. 6, 1998 (2 pages).
GenBank Accession No. AAC39505, dated Jul. 26, 1998 (1 page).
GenBank Accession No. AAD34294, dated Mar. 22, 2000 (2 pages).
GenBank Accession No. AAD34295, dated Mar. 22, 2000 (2 pages).
GenBank Accession No. AAD47596, dated Aug. 9, 1999 (2 pages).
GenBank Accession No. AAH69913, dated Jul. 15, 2006 (2 pages).
GenBank Accession No. AEE36246, dated Oct. 6, 2014 (3 pages).
GenBank Accession No. AAR06912, dated Dec. 28, 2004 (2 pages).
GenBank Accession No. AAR06916.1, dated Dec. 28, 2004 (2 pages).
GenBank Accession No. AAR06920.1, dated Dec. 28, 2004 (2 pages).
GenBank Accession No. ABA42921, dated Jun. 21, 2006 (1 page).
GenBank Accession No. ABB88839, dated May 28, 2008 (2 pages).
GenBank Accession No. ABC59076, dated Jun. 6, 2007 (1 page).
GenBank Accession No. ABC98596, dated Jan. 31, 2014 (2 pages).
GenBank Accession No. ABD60225, dated May 28, 2008 (2 pages).
GenBank Accession No. ABD92926, dated Oct. 10, 2007 (2 pages).
GenBank Accession No. AC133334, dated Jan. 31, 2004 (44 pages).
GenBank Accession No. ACD93722, dated Jun. 10, 2008 (1 page).
GenBank Accession No. AF034774, dated Apr. 17, 1998 (2 pages).
GenBank Accession No. AY562490, dated May 23, 2006 (3 pages).
GenBank Accession No. BAA43200, dated Mar. 13, 1999 (2 pages).
GenBank Accession No. BAB59027, dated Jan. 30, 2002 (1 page).
GenBank Accession No. BAF61135, dated May 9, 2007 (2 pages).
GenBank Accession No. BAG30962, dated Nov. 12, 2012 (2 pages).
GenBank Accession No. BC153262, dated Oct. 4, 2007 (3 pages).
GenBank Accession No. CAA75568, dated Nov. 14, 2006 (2 pages).
GenBank Accession No. CAA76703, dated Nov. 14, 2006 (1 page).
GenBank Accession No. CAE09055, dated Nov. 14, 2005 (2 pages).
GenBank Accession No. CAG41604, dated Feb. 6, 2015 (2 pages).
GenBank Accession No. D03988713, dated May 28, 2008 (2 pages).
GenBank Accession No. EDY51667, dated Sep. 2, 2008 (2 pages).
GenBank Accession No. EU263989, dated Jun. 11, 2008 (2 pages).
GenBank Accession No. NM_116512, dated Jan. 22, 2014 (3 pages).
GenBank Accession No. NP_001105097, dated Aug. 4, 2015 (2 pages).
GenBank Accession No. NP_013636.1 (YML075C), dated Jul. 16, 2015 (3 pages).
GenBank Accession No. NP_194183, dated Jan. 22, 2014 (4 pages).
GenBank Accession No. NP_195399, dated Jan. 22, 2014 (3 pages).
GenBank Accession No. NP_197872.1, dated Jan. 22, 2014 (2 pages).
GenBank Accession No. Q9UVY5.1, dated Apr. 1, 2015 (3 pages).
Uniprot Accession No. P07213, dated Feb. 17, 2016 (pp. 1-12).
Uniprot Accession No. P41948, dated Feb. 17, 2016 (pp. 1-12).
Uniprot Accession No. P38967, dated Feb. 17, 2016 (pp. 1-12).
Uniprot Accession No. Q08234, dated Feb. 17, 2016 (pp. 1-12).
Uniprot Accession No. P81451, dated Nov. 11, 2015 (pp. 1-8).
Uniprot Accession No. P38925, dated Jan. 20, 2016 (pp. 1-11).
Uniprot Accession No. Q12067, dated Dec. 9, 2015 (pp. 1-9).
Uniprot Accession No. Q12324, dated Jan. 20, 2016 (pp. 1-10).
Uniprot Accession No. Q99252, dated Jan. 20, 2016 (pp. 1-10).
Uniprot Accession No. Q12375, dated Feb. 17, 2016 (pp. 1-10).
Uniprot Accession No. Q99297, dated Feb. 17, 2016 (pp. 1-10).
Uniprot Accession No. Q12697, dated Feb. 17, 2016 (pp. 1-12).
Uniprot Accession No. Q08777, dated Feb. 17, 2016 (pp. 1-11).
Uniprot Accession No. P32798, dated Feb. 17, 2016 (pp. 1-11).
Uniprot Accession No. Q01926, dated Feb. 17, 2016 (pp. 1-9).
Uniprot Accession No. P05626, dated Feb. 17, 2016 (pp. 1-10).
Uniprot Accession No. P33311, dated Dec. 9, 2015 (pp. 1-11).
Uniprot Accession No. Q08986, dated Feb. 17, 2016 (pp. 1-12).
Uniprot Accession No. P53394, dated Feb. 17, 2016 (pp. 1-10).
Uniprot Accession No. Q12251, dated Feb. 17, 2016 (pp. 1-9).
Uniprot Accession No. P32331, dated Feb. 17, 2016 (pp. 1-9).
Uniprot Accession No. Q06497, dated Feb. 17, 2016 (pp. 1-10).
Uniprot Accession No. Q06598, dated Feb. 17, 2016 (pp. 1-13).
Uniprot Accession No. P38124, dated Feb. 17, 2016 (pp. 1-9).
Uniprot Accession No. P05316, dated Jan. 20, 2016 (pp. 1-10).
Uniprot Accession No. P38227, dated Feb. 17, 2016 (pp. 1-11).
Uniprot Accession No. P38355, dated Jan. 20, 2016 (pp. 1-9).
Uniprot Accession No. P38360, dated Feb. 17, 2016 (pp. 1-13).
Uniprot Accession No. P38361, dated Jan. 20, 2016 (pp. 1-10).
Uniprot Accession No. P25568, dated Jan. 20, 2016 (pp. 1-11).
Uniprot Accession No. P25371, dated Jan. 20, 2016 (pp. 1-13).
Uniprot Accession No. Q07376, dated Jan. 20, 2016 (pp. 1-10).
Uniprot Accession No. Q12154, dated Dec. 9, 2015 (pp. 1-12).
Uniprot Accession No. P54854, dated Feb. 17, 2016 (pp. 1-10).
Uniprot Accession No. P0CD99, dated Feb. 17, 2016 (pp. 1-10).
Uniprot Accession No. P32568, dated Feb. 17, 2016 (pp. 1-12).
Uniprot Accession No. P32916, dated Jan. 20, 2016 (pp. 1-10).
Uniprot Accession No. P30605, dated Feb. 17, 2016 (pp. 1-12).
Uniprot Accession No. P39953, dated Feb. 17, 2016 (pp. 1-10).

(56) References Cited

OTHER PUBLICATIONS

Uniprot Accession No. P25515, dated Jan. 20, 2016 (pp. 1-11).
Uniprot Accession No. P39980, dated Feb. 17, 2016 (pp. 1-10).
Uniprot Accession No. P52871, dated Nov. 11, 2015 (pp. 1-9).
Uniprot Accession No. P40035, dated Feb. 17, 2016 (pp. 1-10).
Uniprot Accession No. P40074, dated Jan. 20, 2016 (pp. 1-10).
Uniprot Accession No. P43569, dated Dec. 9, 2015 (pp. 1-9).
Uniprot Accession No. P43617, dated Feb. 17, 2016 (pp. 1-9).
Uniprot Accession No. P53154, dated Jan. 20, 2016 (pp. 1-10).
Uniprot Accession No. P53142, dated Jan. 20, 2016 (pp. 1-11).
Uniprot Accession No. P53134, dated Jan. 20, 2016 (pp. 1-9).
Uniprot Accession No. P13586, dated Feb. 17, 2016 (pp. 1-12).
Boer, "Strain and process development for fermentative production of Rebaudiosides" Abstract of Offered Oral from 33rd International Specialised Symposium on Yeasts; Jun. 26-29, 2017 University of College Cork, Ireland; pp. 1-2.
Garber et al., "Computational methods for transcriptome annotation and quantification using RNA-seq," Nat Methods 8(6):469-77 (2011).
Kawai et al., "Transformation of *Saccharomyces cerevisiae* and other fungi: methods and possible underlying mechanism," Bioeng Bugs. 1(6):395-403 (2010).
Lin et al., "Arrestin-related ubiquitin-ligase adaptors regulate endocytosis and protein turnover at the cell surface," Cell 135(4):714-25 (2008).
Mahe et al., "The ATP Binding Cassette Transporters Pdr5 and Snq2 of *Saccharomyces cerevisiae* Can Mediate Transport of Steriods via in Vivo", JBC, 271(41):25167-25172. (Oct. 1996).
Nagalakshmi et al., "The transcriptional landscape of the yeast genome defined by RNA sequencing," Science 320 (5881 ): 1344-9 (2008).
Nikko et al. "Arrestin-like proteins mediate ubiquitination and endocytosis of the yeast metal transporter Smf1," EMBO Rep. 9(12):1216-21 (2008).
Nikko & Pelham, "Arrestin-mediated endocytosis of yeast plasma membrane transporters," Traffic 10(12):1856-67 (2009).
Ohta et al., MassBank Accession No. FU000299 (May 2016).
Ohta et al., MassBank Accession No. FU000332 (May 2016).
Olsson et al., "Microbial production of next-generation stevia sweeteners," Microbial Cell Factories, 15:11-14 (2016).
Partow et al., "Characterization of different promoters for designing a new expression vector in *Saccharomyces cerevisiae*," Yeast 27:955-64 (2010).
Robinson & Oshlack et al., "A scaling normalization method for differential expression analysis of RNA-seq data," Genome Biol. 11(3):R25 (2010).
Saier Jr. et al., "The transporter classification database," Nucl. Acids Res., 42(1):D251-258 (2014).
Song et al., "The *Aspergillus fumigatus* 1-29 damage resistance protein family coordinately regulates ergosterol biosynthesis and azole susceptibility," MBIO, 7:1-13 (2016).
Starratt et al., "Rebaudioside F, a diterpene glycoside from Stevia redaudiana", Phytochemistry, 59(4):367-370. (Feb. 2002). Abstract.
Wang et al., "RNA-Seq: a revolutionary tool for transcriptomics," Nat Rev Genet. 10(1):57-63 (2009).
Wilhelm et al., "Defining transcribed regions using RNA-seq," Nature Protocols 5:255-66 (2010).
Yang Quanhua et.al., "Analysis of the Chemical constituents of Stevia rebaudiana and its sweetness," Journal of Beijing University of Chemical Technology, vol. 39, No. 2., p. 28-32 (2012) (English Abstract).
Non-Final Office Action for U.S. Appl. No. 14/761,629, dated Mar. 21, 2017 (pp. 1-19).
Final Office Action for U.S. Appl. No. 14/761,629, dated Aug. 11, 2017 (pp. 1-16).
Third Party Observation in EP Application No. 13801569.8; dated Apr. 26, 2017. pp. 1-5.
International Search Report and Written Opinion of International Search Authority for International Application No. PCTEP2017/059028; dated Jun. 27, 2017, pp. 1-15.

Non-Final Office Action for U.S. Appl. No. 14/764,898, dated Mar. 30, 2017, pp. 1-17.
Chen, "Summary on Study of Stevioside," China Pharmacist, vol. 10, No. 6, p. 598-599 (2007).
Chen et al., "Sugar transporters for intercellular exchange and nutrition of pathogens," Nature 468(7323):527-32 (2010).
Chen et al., "Fusion protein linkers: Property, design, and functionality", Advanced Drug Delivery reviews, 65 (0):1257-69 (2013).
Daran et al., "Genetic and biochemical characterization of the UGP1 gene encoding the UDP-glucose pyrophosphorylase from *Saccharomyces cerevisiae*," Eur J Biochem. 233(2):520-30 (1995).
Husar et al., "Overexpression of the UGT73C6 alters brassinosteriod glucoside formation in *Arabidopsis thaliana*", BMC Plant Biology, 11:1-14 (2011).
Mao et al., "Produce steviol glycosides in engineered yeast", 2015 Synthetic Biology: Engineering, Evolution & Design (SEED), Poster Abstract (Jun. 2015).
Nagatoshi et al., "UGT75L6 and UGT94E5 mediate sequential glucosylation of crocetin to crocin in Gardenia lasminoides", FEBS Letters, 586:1055-1061 (2012).
Tiwari et al., "Plant secondary metabolism linked glycosyltransferases: An update on expaning knowledge and scopes", Biotechnology Advances, 34:714-739 (May 2016).
Wang et al., "Pathway mining-based integration of critical enzyme parts for de novo biosynthesis of steviolglycoside sweetener in *Escherichia coli*", Cell Research, 26:258-261 (Sep. 2015).
Wang et al., "Efficient enzymatic production of rebaudioside a from stevioside", Bioscience, Biotechnology, and Biochemistry, 80:67-73 (Aug. 2015).
Wang et al., "Design and construction of artificial biological systems for complex natural products biosynthesis," Chinese Journal of Biotechnology, 29(8):1146-60 (2013.
Warth et al., "Hydrophilic interaction liquid chromatography coupled with tandem mass spectrometry for the quantification of uridine diphosphate-glucose, uridine diphosphate-glucuronic acid, deoxynivalenol and its glucoside: In-house validation and application to wheat," Journal of Chromatography A, 1423, pp. 183-189 (2015).
Yang et al., "Base substitution mutations in uridinediphosphate-dependent glycosyltransferase 76G1 gene of Stevia rebaudiana causes the low levels of rebaudioside A: mutations in UGT76G1, a key gene of steviol glycosides synthesis," Plant Physiol Biochem. 80:220-5 (2014).
Communication pursuant to Article 94(3) EPC in European Application No. 15193074.0; dated Jul. 31, 2017 pp. 1-4.
Final Office Action for U.S. Appl. No. 14/648747, dated Sep. 6, 2017 (pp. 1-19).
Third Party Observation in EP Application No. 13801569.8; dated Oct. 23, 2017. pp. 1-6.
International Search Report and Written Opinion of International Search Authority for International Application No. PCT/EP2017/055589; dated May 12, 2017, pp. 1-18.
International Search Report of the International Searching Authority for International Application No. PCT/EP2017/061774; dated Aug. 30, 2017, pp. 1-20.
Written Opinion of the International Searching Authority for International Application No. PCT/EP2017/061774; dated Aug. 30, 2017, pp. 1-13.
International Search Report and Written Opinion of the International Searching Authority for International Application No. PCT/EP2017/061775; dated Sep. 6, 2017, pp. 1-17.
Communication of a Notice of Opposition issued by the European Patent Office for European Application No. 12750513.9, dated Mar. 6, 2017 (pp. 1-8).
Statement of fact and arguments in support of opposition, dated Feb. 28, 2017 (pp. 1-24).
Uniprot Accession No. Q75I83, dated Jul. 5, 2004 (pp. 1-2).
Uniprot Accession No. Q75I83, dated Jul. 22, 2008 (pp. 1-4).
Sequence alignment between the sequence of Uniprot database entry Q75I83 version 31, updated Jul. 22, 2008 and SEQ ID No. 152 (from European Patent No. 2742142) as cited in Notice of Opposition against EP Application No. 12750513.9; dated Mar. 6, 2017; pp. 1-2.

(56) References Cited

OTHER PUBLICATIONS

Uniprot Accession No. P53320, dated Feb. 17, 2016 (pp. 1-10).
Uniprot Accession No. P38735, dated Feb. 17, 2016 (pp. 1-13).
Uniprot Accession No. P38734, dated Feb. 17, 2016 (pp. 1-10).
Uniprot Accession No. P38702, dated Feb. 17, 2016 (pp. 1-9).
Uniprot Accession No. P38695, dated Feb. 17, 2016 (pp. 1-11).
Uniprot Accession No. P40556, dated Feb. 17, 2016 (pp. 1-10).
Uniprot Accession No. P40475, dated Feb. 17, 2016 (pp. 1-9).
Uniprot Accession No. P40474, dated Jan. 20, 2016 (pp. 1-11).
Uniprot Accession No. P40445, dated Dec. 9, 2015 (pp. 1-9).
Uniprot Accession No. P10566, dated Feb. 17, 2016 (pp. 1-10).
Uniprot Accession No. P40885, dated Feb. 17, 2016 (pp. 1-11).
Uniprot Accession No. P30902, dated Nov. 11, 2015 (pp. 1-9).
Uniprot Accession No. P35736, dated Jan. 20, 2016 (pp. 1-8).
Uniprot Accession No. P32332, dated Feb. 17, 2016 (pp. 1-10).
Uniprot Accession No. P36062, dated Jan. 20, 2016 (pp. 1-10).
Uniprot Accession No. P12866, dated Jan. 20, 2016 (pp. 1-14).
Uniprot Accession No. P19145, dated Feb. 17, 2016 (pp. 1-12).
Uniprot Accession No. Q06686, dated Nov. 11, 2015 (pp. 1-9).
Uniprot Accession No. Q03697, dated Feb. 17, 2016 (pp. 1-10).
Uniprot Accession No. Q03829, dated Feb. 17, 2016 (pp. 1-9).
Uniprot Accession No. Q03263, dated Feb. 17, 2016 (pp. 1-10).
Uniprot Accession No. P38921, dated Feb. 17, 2016 (pp. 1-10).
Uniprot Accession No. P32487, dated Feb. 17, 2016 (pp. 1-12).
Uniprot Accession No. P53389, dated Feb. 17, 2016 (pp. 1-10).
Uniprot Accession No. Q08299, dated Feb. 17, 2016 (pp. 1-10).
Uniprot Accession No. Q12289, dated Feb. 17, 2016 (pp. 1-10).
Uniprot Accession No. P33302, dated Feb. 17, 2016 (pp. 1-23).
Uniprot Accession No. Q12029, dated Jan. 20, 2016 (pp. 1-9).
Uniprot Accession No. Q12256, dated Feb. 17, 2016 (pp. 1-12).
Uniprot Accession No. P22215, dated Feb. 17, 2016 (pp. 1-11).
Uniprot Accession No. P22203, dated Jan. 20, 2016 (pp. 1-10).
Uniprot Accession No. P15380, dated Feb. 17, 2016 (pp. 1-11).
Uniprot Accession No. P19657, dated Feb. 17, 2016 (pp. 1-12).
Liu et al., "Functional and Biochemical Characteritzation of *Escherichia coli* Sugar Efflux Transporters," JBC, 274 (33)22977-22984 (Aug. 1999).
Sun et al., "Regulation and Function of *Escherichia coli* Sugar Efflux Transporter a (Set A) during Glucose-Phosphat; Stress," J of Bacteriology, 193(1)143-153 (Jan. 2011).
International Search Report and Written Opinion of the International Searching Authority for International Application No. PCT/EP2016/068259; dated Jan. 24, 2017, pp. 1-18.
Chen et al., "Progress in the Application of Affinity Tags for the Expression and Purification of Recombinant Proteins," China Biotechnology, vol. 32, No. 12, pp. 93-103, Dec. 15, 2012 (English Abstract Translation).
GenBank Accession No. AAS07253.1, dated Jan. 31, 2004 (3 pages).
Gloster, "Advances in understanding glycosyltransferases from a structural perspective," Curr Opin Struct Biol. 28:131-41 (2014).
Guo et al., "Protein tolerance to random amino acid change", Proceedings of the National Academy of Sciences USA, vol. 101, No. 25, pp. 9205-9210 (2004).
Ni et al., "Outer membrane mutation effects on UDP-glucose permeability and whole-cell catalysis rate," Appl Microbiol Biotechnol. 73(2):384-93 (2006).
Prisic et al, "Synergistic substrate inhibition of ent-copalyl diphosphate synthase: a potential feed-forward inhibition mechanism limiting gibberellin metabolism," Plant Physiol. 144(1):445-54 (2007).
Saier, "Families of transmembrane sugar transport proteins," Mol Microbiol., 35(4):699-710 (2000).
Ünligil et al., "Glycosyltransferase structure and mechanism," Curr Opin Struct Biol. 10(5):510-7 (2000).
Wanchao et al., "Advances on the Steviol Glycoside Biosynthesis and Its Key Enzymes," Biotechnology Bulletin, Feb. 2008 (English Abstract Translation).
GenBank Accession No. AZF53544, dated Apr. 14, 2011 (2 pages).
UniProt Accession No. B5MEX6, Nov. 4, 2008 (1 page).
UniProt Accession No. E4MVV7, Feb. 8, 2011 (1 page).
UniProt Accession No. F6KWJ2, Jul. 27, 2011 (1 page).
UniProt Accession No. H9BYK3, May 16, 2012 (1 page).
Shag et al., "Crystal structures of a multifunctional triterpene/flavonoid glycosyltransferase from Medicago truncatula," Plant Cell 17(11):3141-54 (2005).
Shibata et al., "Glucosylation of Steviol and Steviol-Glucosides in Extracts from Stevia rebaudiana Bertoni" Plant Physiol. 95(1):152-56 (1991).
Singh et al., "Compendium of Transgenic Crop Plants: Transgenic Sugar, Tuber and Fiber," Ed. Kole & Hall, Blackwell Publishing Ltd. pp. 97-115 (2008).
U.S. Food and Drug Administration GRAS Notice 323, "GRAS Assessment of High Purity Steviol Glycosides; Food Usage Conditions for General Recognition of Safety for PureCircle USA, Inc.," pp. 1-262 (Feb. 2010).
U.S Food and Drug Administration GRAS Notice Notice 329, "Notice to the U.S. Food and Drug Administration that the use of RebpureTM (Rebaudioside A) derived from Stevia rebaudiana, as a Food Ingredient is Generally Recognized as Safe (GRAS)," pp. 1-275 (Mar. 2010).
Van Ooyen et al., "Heterologous protein production in the yeast Kluyveromyces lactis," FEMS Yeast Res. 6 (3):381-92 (May 2006).
Vazquez De Aldana et al., "Nucleotide sequence of the exo-1,3-beta-glucanase-encoding gene, EXG1, of the yeast *Saccharomyces cerevisiae*," Gene 97(2):173-82 (1991).
Verwaal et al., "High-Level Production of Beta-Carotene in *Saccharomyces cerevisiae* by Successive Transformation with Carotenogenic Genes from Xanthophyllomyces dendrorhous," Appl Environ Microbiol. 73 (13):4342-50 (2007).
Wallin, "Steviol Glycosides," Chem. Tech Assessment—63rd JECFA, pp. 1-5 (2004).
Wallin, "Steviol Glycosides," Chem. Tech Assessment—69th JECFA, pp. 1-7 (2007).
Wallner & Elofsson, "Can correct protein models be identified?," Protein Sci. 12(5):1073-86 (May 2003).
Wang, "Structure, mechanism and engineering of plant natural product glycosyltransferases," FEBS Letters 583 (20):3303-9 (2009).
Xu et al., "Generation of hepatitis B virus PreS2-S antigen in Hansenula polymorpha," Virol Sin. 29(6):403-9 (Dec. 2014).
Yadav et al., "A review on the improvement of stevia [*Stevia rebaudiana* (Bertoni)]," Can J Plant Sci. 91:1-27 (2011).
Yao et al., "A genetic linkage map for Stevia rebaudiana," Genome 42:657-61 (1999).
Yazaki, "ABC transporters involved in the transport of plant secondary metabolites," FEBS Lett. 580(4):1183-91 (Feb. 2006).
Yu et al., "Bioconversion of ethyl 4-chloro-3-oxobutanoate by permeabilized fresh brewer's yeast cells in the presence of allyl bromide," J Ind Microbiol Biotechnol. 34(2)151-6 (2007).
Yuan et al., "Kinetics and activation parameters for oxidations of styrene by Compounds I from the cytochrome P450 (BM-3) (CYP102A1) heme domain and from CYP119," Biochemistry 48(38):9140-6 (Sep. 2009).
Zheng et al. "An efficient one-step site-directed and site-saturation mutagenesis protocol," Nucleic Acids Res. 32(14): e115 (Aug. 2004).
Zhu et al., "A multi-omic map of the lipid-producing yeast Rhodosporidium toruloides," Nature Commun. 3:1112 (Oct. 2012).
GenBank Accession No. AAF61439.1, dated Sep. 25, 2000 (2 pages).
GenBank Accession No. AAM53963.1, dated Jun. 17, 2002 (2 pages).
GenBank Accession No. AAR06918.1, dated Dec. 28, 2004 (2 pages).
GenBank Accession No. AAT93110.1, dated Apr. 24, 2007 (2 pages).
GenBank Accession No. ACE87855.1, dated Jun. 24, 2008 (1 page).
GenBank Accession No. ACM47734.1, dated Feb. 7, 2009 (1 page).
GenBank Accession No. ACT33422.1, dated Jul. 17, 2009 (1 page).
GenBank Accession No. AF515727.1, dated Jun. 17, 2002 (2 pages).
GenBank Accession No. AY345974.1, dated Dec. 28, 2004 (2 pages).

(56) References Cited

OTHER PUBLICATIONS

GenBank Accession No. AY345978.1, dated Dec. 28, 2004 (2 pages).
Genbank Accession No. AY345980.1, dated Dec. 28, 2004 (2 pages).
GenBank Accession No. AY345982.1, dated Dec. 28, 2004 (2 pages).
GenBank Accession No. BG521726.1, dated May 13, 2000 (2 pages).
GenBank Accession No. CAA23011.1, dated Oct. 23, 2008 (2 pages).
GenBank Accession No. CAA46815.1, dated Apr. 18, 2005 (2 pages).
GenBank Accession No. D0269454A, dated May 28, 20085 (2 pages).
GenBank Accession No. EU722415.1, dated Jun. 10, 2008 (2 pages).
GenBank Accession No. EU751291.1, dated Jun. 24, 2008 (2 pages).
EBI Accession No. AAY05902, "Jerusalem artichoke in-chain hydroxylase CYP8161" (1 page).
EBI Accession No. ABM86477, "Rice abiotic stress responsive polypeptide SEQ ID No. 4723" (1 page).
UniProt Accession No. F2DG34, May 2011 (pp. 1-4).
UniProt Accession No. Q6VAA8, 2004 (pp. 1-6).
UniProt Accession No. Q7FPQ4, 2004 (pp. 1-6).
Uniprot Accession No. P38125, dated Feb. 17, 2016 (pp. 1-11).
Uniprot Accession No. P39709, dated Jan. 20, 2016 (pp. 1-10).
Uniprot Accession No. P38176, dated Feb. 17, 2016 (pp. 1-9).
Uniprot Accession No. P07251, dated Jan. 20, 2016 (pp. 1-11).
Uniprot Accession No. P38142, dated Jan. 20, 2016 (pp. 1-11).
Uniprot Accession No. P38359, dated Feb. 17, 2016 (pp. 1-11).
Uniprot Accession No. P25594, dated Feb. 17, 2016 (pp. 1-9).
Uniprot Accession No. P25621, dated Feb. 17, 2016 (pp. 1-10).
Uniprot Accession No. P17261, dated Dec. 9, 2015 (pp. 1-10).
Uniprot Accession No. Q99385, dated Jan. 20, 2016 (pp. 1-10).
Uniprot Accession No. P17255, dated Jan. 20, 2016 (pp. 1-14).
Uniprot Accession No. P10870, dated Feb. 17, 2016 (pp. 1-12).
Uniprot Accession No. P32837, dated Feb. 17, 2016 (pp. 1-10).
Uniprot Accession No. Q12298, dated Nov. 11, 2015 (pp. 1-9).
Uniprot Accession No. Q12675, dated Feb. 17, 2016 (pp. 1-13).
Uniprot Accession No. Q05497, dated Jan. 20, 2016 (pp. 1-9).
Uniprot Accession No. Q04182, dated Feb. 17, 2016 (pp. 1-12).
Uniprot Accession No. P39932, dated Feb. 17, 2016 (pp. 1-11).
Uniprot Accession No. P39986, dated Feb. 17, 2016 (pp. 1-13).
Uniprot Accession No. P32660, dated Feb. 17, 2016 (pp. 1-13).
Uniprot Accession No. P43581, dated Feb. 17, 2016 (pp. 1-11).
Uniprot Accession No. P38929, dated Feb. 17, 2016 (pp. 1-12).
Uniprot Accession No. P12383, dated Feb. 17, 2016 (pp. 1-11).
Uniprot Accession No. P32804, dated Jan. 20, 2016 (pp. 1-10).
Uniprot Accession No. P53273, dated Feb. 17, 2016 (pp. 1-12).
Uniprot Accession No. P53299, dated Jan. 20, 2016 (pp. 1-9).
Uniprot Accession No. P50077, dated Feb. 17, 2016 (pp. 1-13).
Uniprot Accession No. P50080, dated Feb. 17, 2016 (pp. 1-10).
Uniprot Accession No. P53049, dated Feb. 17, 2016 (pp. 1-13).
Uniprot Accession No. P33413, dated Feb. 17, 2016 (pp. 1-13).
Uniprot Accession No. P40501, dated Feb. 17, 2016 (pp. 1-10).
Uniprot Accession No. P40310, dated Feb. 17, 2016 (pp. 1-11).
Uniprot Accession No. P40309, dated Jan. 20, 2016 (pp. 1-11).
Uniprot Accession No. P42946, dated Nov. 11, 2015 (pp. 1-9).
Uniprot Accession No. P40897, dated Jan. 20, 2016 (pp. 1-11).
Uniprot Accession No. P47144, dated Jan. 20, 2016 (pp. 1-9).
Uniprot Accession No. POCE00, dated Feb. 17, 2016 (pp. 1-10).
Uniprot Accession No. P35724, dated Jan. 20, 2016 (pp. 1-10).
Uniprot Accession No. P28584, dated Feb. 17, 2016 (pp. 1-10).
Uniprot Accession No. P36172, dated Feb. 17, 2016 (pp. 1-10).
Uniprot Accession No. P36173, dated Feb. 17, 2016 (pp. 1-10).
Uniprot Accession No. P32366, dated Nov. 11, 2015 (pp. 1-10).
Uniprot Accession No. P13090, dated Feb. 17, 2016 (pp. 1-12).
Uniprot Accession No. Q05131, dated Feb. 17, 2016 (pp. 1-12).
Uniprot Accession No. P04710, dated Feb. 17, 2016 (pp. 1-11).
Uniprot Accession No. Q04835, dated Jan. 20, 2016 (pp. 1-10).
Uniprot Accession No. P53943, dated Feb. 17, 2016 (pp. 1-11).
Uniprot Accession No. P53507, dated Dec. 9, 2015 (pp. 1-9).
Uniprot Accession No. D6W196, dated Feb. 17, 2016 (pp. 1-11).
Uniprot Accession No. P53932, dated Jan. 20, 2016 (pp. 1-9).
Khan et al., "Physical and chemical mutagenesis in Stevia rebaudiana: variant generation with higher UGT expression and glycosidic profile but with low photosynthetic capabilities," Acta Physiologiae Plantarum 38(1) (2016).
Liu et al., "Biosynthesis of Rebaudioside A by Whole Cell of Recombinant *Saccharomyces cerevisiae*," Food and Fermentation Industries, 38(7) : 6-10 (2012) (Abstract translation).
Third Party Submission in U.S. Appl. No. 15/506,196; dated Mar. 9, 2018 pp. 1-68.
International Search Report and Written Opinion of the International Searching Authority for International Application No. PCT/EP2017/078473; dated Jan. 25, 2018, pp. 1-16.
Arnold, F. H. "Combinatorial and computational challenges for biocatalyst design," Nature 409(6817):253-257 (2001).
EBI Accession No. AAY05902, "Jerusalem artichoke in-chain hydroxylase CYP8161" (1 page), Jun. 15, 2009.
EBI Accession No. ABM86477, "Rice abiotic stress responsive polypeptide SEQ ID No. 4723" (1 page), dated Jun. 2, 2005.
Extended European Search Report and Opinion issued by the European Patent Office for European Application No. 11790428.4, dated Dec. 20, 2013 (7 pages).
Search Report issued by the Intellectual Property Office of Singapore for Singaporean Application No. 201208854-8, dated Nov. 3, 2014 (8 pages).
International Search Report issued by the International Searching Authority for International Application No. PCT/US2012/050021, dated Apr. 12, 2013 (pp. 1-8).
Written Opinion of the International Searching Authority for International Application No. PCT/US2012/050021, dated Apr. 12, 2013 (pp. 1-10).
International Preliminary Report on Patentability issued by the International Bureau for International Application No. PCT/US2012/050021, dated Feb. 11, 2014 (pp. 1-11).
Bruyn et al., "Metabolic engineering of *Escherichia coli* into a versatile glycosylation platform: production of bio-active quercetin glycosides," Microb Cell Fact., 14:138 (2015).
Bruyn et al., "Development of an in vivo glucosylation platform by coupling production to growth: production of phenolic glucosides by a glycosyltransferase of Vitis vinifera," Biotechnol Bioeng., 112(8):1594-603 (2015).
Duetz "Microtiter plates as mini-bioreactors: miniaturization of fermentation methods," Trends Microbiol 15 (10):469-75 (2007).
François et al., "Reserve carbohydrates metabolism in the yeast *Saccharomyces cerevisiae*," FEMS Microbiol Rev., ?5(1):125-45 (2001).
International Preliminary Report on Patentability from the International Bureau for International Application PCTEP2016/080516; dated Jun. 12, 2018 (pp. 1-11).
International Preliminary Report on Patentability from the International Bureau for International Application PCT/EP2017/061775; dated Nov. 20, 2018 (pp. 1-9).
International Preliminary Report on Patentability from the International Bureau for International Application PCTEP2017/059028; dated Oct. 16, 2018 (pp. 1-7).
International Preliminary Report on Patentability from then International Search Authority for International Application No. PCT/EP2017/061774; dated Nov. 20, 2018, pp. 1-14.

* cited by examiner

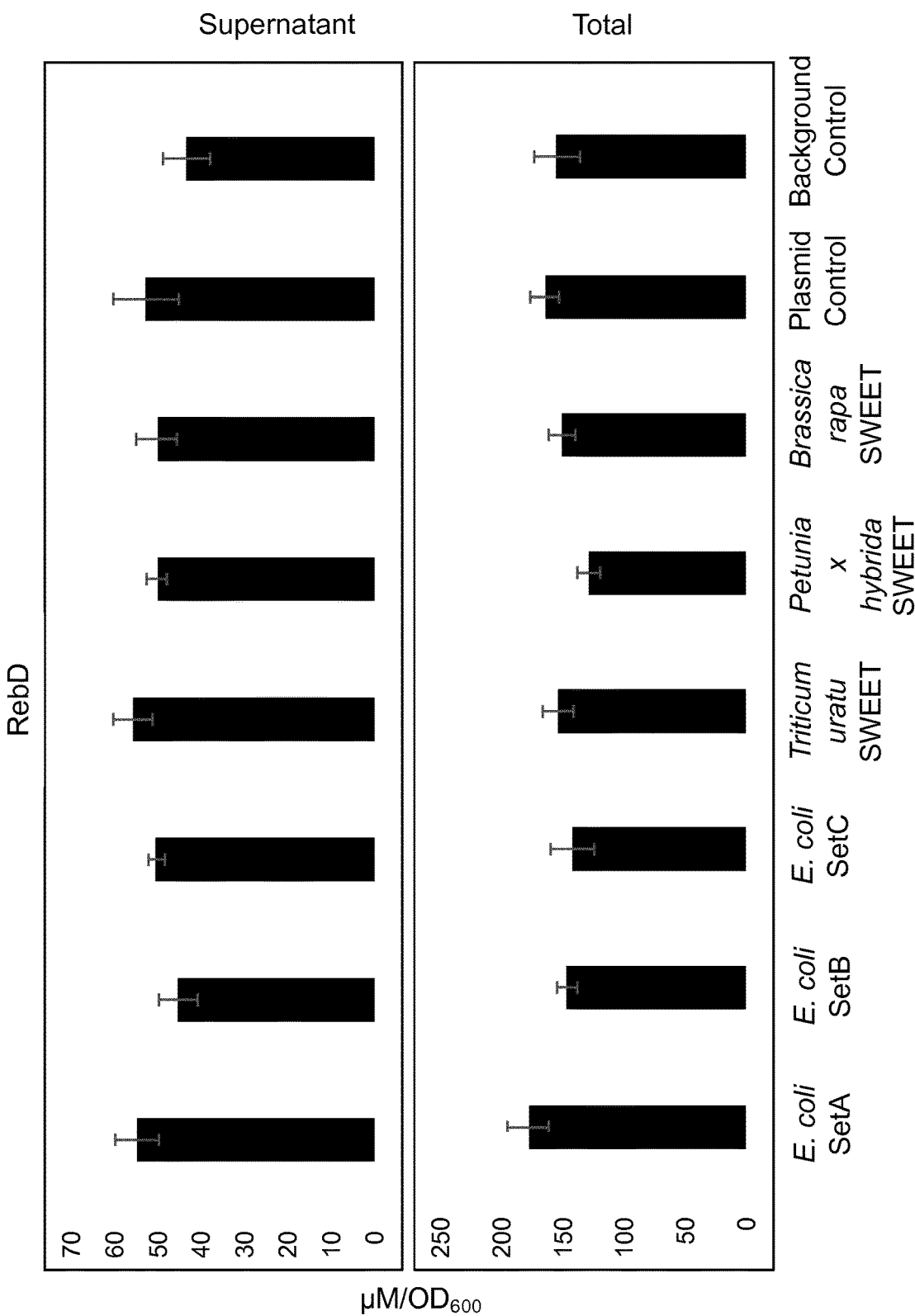

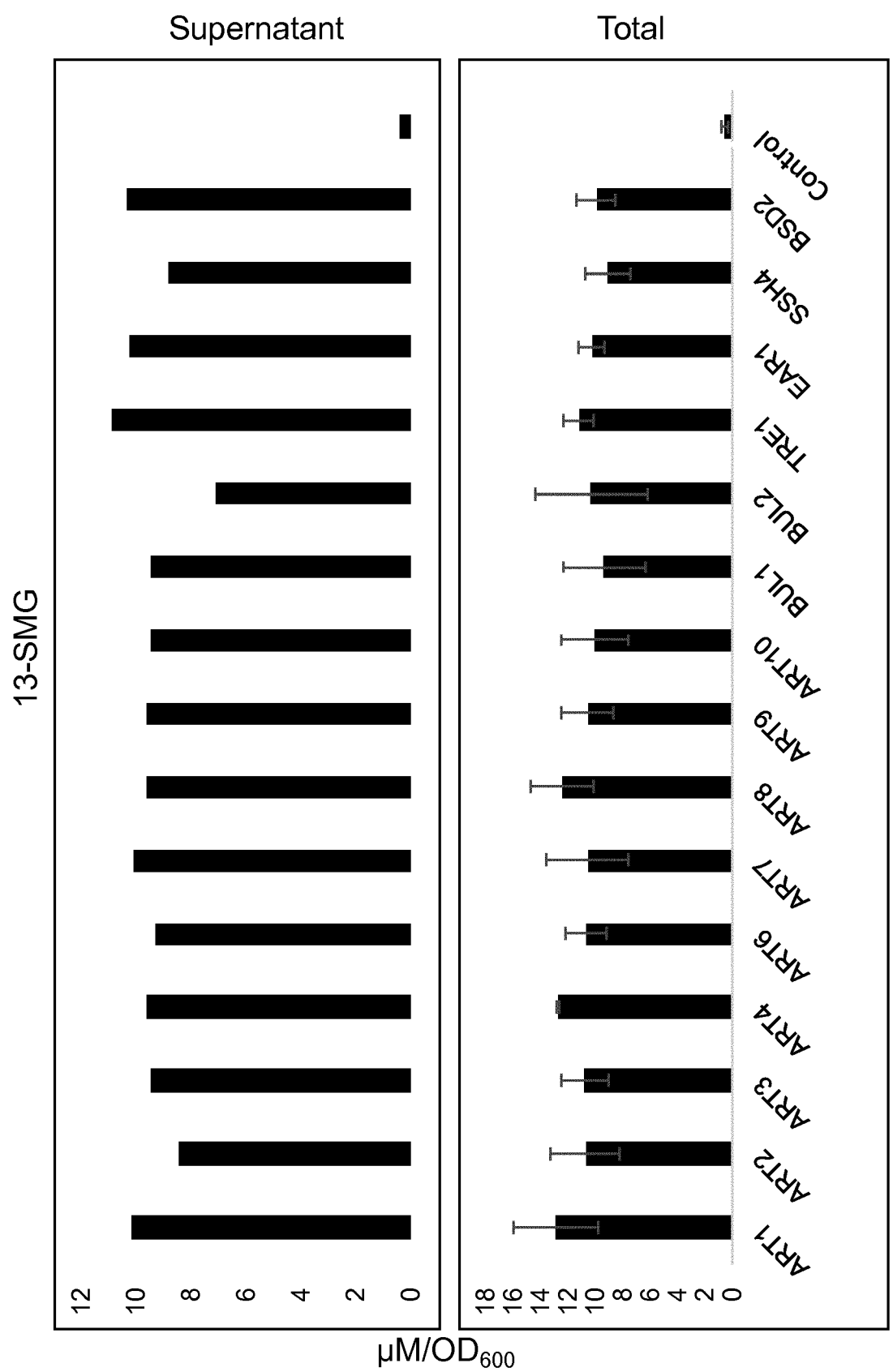

PRODUCTION OF STEVIOL GLYCOSIDES IN RECOMBINANT HOSTS

This application is a U.S. national phase of International Application No. PCT/EP2016/068259 filed Jul. 29, 2016, which claims the benefit of U.S. Provisional Application No. 62/202,620, filed Aug. 7, 2015. The entire disclosure contents of these applications are herewith incorporated by reference in their entirety into the present application.

BACKGROUND OF THE INVENTION

Field of the Invention

This disclosure relates generally to recombinant production of steviol glycosides such as rebaudioside A (RebA), rebaudioside B (RebB), rebaudioside D (RebD), and rebaudioside M (RebM) by recombinant hosts, such as recombinant microorganisms, and isolation methods thereof. In particular, this disclosure relates to modifications to transport systems in a recombinant host to increase production of such steviol glycosides and/or excretion of such steviol glycosides into the culture medium of the recombinant host.

Description of Related Art

Sweeteners are well known as ingredients used most commonly in the food, beverage, or confectionary industries. The sweetener can either be incorporated into a final food product during production or for stand-alone use, when appropriately diluted, as a tabletop sweetener or an at-home replacement for sugars in baking. Sweeteners include natural sweeteners such as sucrose, high fructose corn syrup, molasses, maple syrup, and honey and artificial sweeteners such as aspartame, saccharine, and sucralose. Stevia extract is a natural sweetener that can be isolated and extracted from a perennial shrub, Stevia rebaudiana. Stevia is commonly grown in South America and Asia for commercial production of stevia extract. Stevia extract, purified to various degrees, is used commercially as a high intensity sweetener in foods and in blends or alone as a tabletop sweetener.

Chemical structures for several steviol glycosides are shown in FIG. 1, including the diterpene steviol and various steviol glycosides. Extracts of the Stevia plant generally comprise steviol glycosides that contribute to the sweet flavor, although the amount of each steviol glycoside often varies, inter alia, among different production batches.

As recovery and purification of steviol glycosides from the Stevia plant have proven to be labor intensive and inefficient, there remains a need for a recombinant production system that can produce high yields of desired steviol glycosides, such as RebD and RebM. There also remains a need for improved production of steviol glycosides in recombinant hosts for commercial uses.

SUMMARY OF THE INVENTION

It is against the above background that the present invention provides certain advantages and advancements over the prior art.

In particular, the invention provides a recombinant host cell capable of producing at least one steviol glycoside, wherein the host comprises:
  (a) a gene encoding a Sugar Efflux Transporter (SET) polypeptide; and/or
  (b) a gene encoding a Sugar Transporter SWEET (SWEET) polypeptide;

wherein at least one of the genes is a recombinant gene.

In one aspect of the recombinant host cell disclosed herein, SET polypeptide has at least 50% identity to *E. coli* Sugar Efflux Transporter A (SetA) polypeptide set forth in SEQ ID NO:18, *E. coli* Sugar Efflux Transporter B (SetB) polypeptide set forth in SEQ ID NO:20, or *E. coli* Sugar Efflux Transporter C (SetC) polypeptide set forth in SEQ ID NO:22.

In one aspect of the recombinant host cell disclosed herein, the SWEET polypeptide has at least 50% identity to *Brassica rapa* SWEET polypeptide set forth in SEQ ID NO:24, *Petunia*×hybrid SWEET polypeptide set forth in SEQ ID NO:26, or *Triticum urartu* SWEET polypeptide set forth in SEQ ID NO:28.

The invention further provides a recombinant host cell capable of producing at least one steviol glycoside, wherein the host comprises a deletion of a gene encoding a trafficking adapter polypeptide.

In one aspect of the recombinant host cell disclosed herein, prior to deletion the deleted gene encodes the trafficking adapter polypeptide having at least 50% identity to any one of adapter protein Art10 set forth in SEQ ID NO:30, adapter protein Art1 set forth in SEQ ID NO:32, adapter protein Art2 set forth in SEQ ID NO:34, adapter protein Art3 set forth in SEQ ID NO:36, adapter protein Art4 set forth in SEQ ID NO:38, adapter protein Art6 set forth in SEQ ID NO:40, adapter protein Art7 set forth in SEQ ID NO:42, adapter protein Art8 set forth in SEQ ID NO:44, adapter protein adapter protein Art9 set forth in SEQ ID NO:166, adapter protein Bul1 set forth in SEQ ID NO:46, adapter protein Bul2 set forth in SEQ ID NO:48, adapter protein Bsd2 set forth in SEQ ID NO:168, adapter protein Ear1 set forth in SEQ ID NO:170, adapter protein Ssh4 set forth in SEQ ID NO:172, or adapter protein Tre1 set forth in SEQ ID NO:174.

In one aspect of the recombinant host cell disclosed herein, deletion of adapter protein Art3 set forth in SEQ ID NO:36, adapter protein Art7 set forth in SEQ ID NO:42, adapter protein Art9 set forth in SEQ ID NO:166, adapter protein Art10 set forth in SEQ ID NO:30, or adapter protein Bul1 set forth in SEQ ID NO:46 increases excretion of RebD.

In one aspect of the recombinant host cell disclosed herein, deletion of adapter protein Art1 set forth in SEQ ID NO:32, adapter protein Art2 set forth in SEQ ID NO:34, adapter protein Art3 set forth in SEQ ID NO:36, adapter protein Art4 set forth in SEQ ID NO:38, adapter protein Art6 set forth in SEQ ID NO:40, adapter protein Art7 set forth in SEQ ID NO:42, adapter protein Art8 set forth in SEQ ID NO:44, adapter protein Art9 set forth in SEQ ID NO:166, adapter protein Art10 set forth in SEQ ID NO:30, adapter protein Bul1 set forth in SEQ ID NO:46, adapter protein Bul2 set forth in SEQ ID NO:48, adapter protein Tre1 set forth in SEQ ID NO:174, adapter protein Ear1 set forth in SEQ ID NO:170, or adapter protein Ssh4 set forth in SEQ ID NO:172 increases excretion of RebM.

The invention further provides a recombinant host cell capable of producing at least one steviol glycoside, wherein the host comprises a deletion of a gene encoding a transporter polypeptide, wherein the transporter polypeptide is YOR087W set forth in SEQ ID NO:2, YML038C set forth in SEQ ID NO:4, YJR135W-A set forth in SEQ ID NO:6, YDR406W set forth in SEQ ID NO:8, YIR028W set forth in SEQ ID NO:10, YGR138C set forth in SEQ ID NO:12, YJL214W set forth in SEQ ID NO:14, YDR345C set forth in SEQ ID NO:16, or a functional homolog thereof.

The invention further provides a recombinant host cell capable of producing at least one steviol glycoside, wherein the host comprises a deletion of a gene encoding a transporter polypeptide, wherein the transporter polypeptide is YBR068C set forth in SEQ ID NO:64, YBR220C set forth in SEQ ID NO:66, YBR235W set forth in SEQ ID NO:68, YBR293W set forth in SEQ ID NO:70, YBR298C set forth in SEQ ID NO:72, YCR011C set forth in SEQ ID NO:74, YCR023C set forth in SEQ ID NO:76, YDL1000 set forth in SEQ ID NO:78, YDL119C set forth in SEQ ID NO:80, YDL138W set forth in SEQ ID NO:82, YDL199C set forth in SEQ ID NO:84, YDL210W set forth in SEQ ID NO:86, YDL245C set forth in SEQ ID NO:88, YDR061W set forth in SEQ ID NO:90, YDR135C set forth in SEQ ID NO:92, YDR508C set forth in SEQ ID NO:94, YEL006W set forth in SEQ ID NO:96, YFL028C set forth in SEQ ID NO:98, YGL006W set forth in SEQ ID NO:100, YGL114W set forth in SEQ ID NO:102, YGR125W set forth in SEQ ID NO:104, YGR181W set forth in SEQ ID NO:106, YIL088C set forth in SEQ ID NO:108, YJR124C set forth in SEQ ID NO:110, YPL134C set forth in SEQ ID NO:112, YPR192W set forth in SEQ ID NO:114, YPR194C set forth in SEQ ID NO:116, YPR198W set forth in SEQ ID NO:118, YPR201W set forth in SEQ ID NO:120, YAL067C set forth in SEQ ID NO:122, YBL089W set forth in SEQ ID NO:124, YCR028C set forth in SEQ ID NO:126, YDR438W set forth in SEQ ID NO:128, YFL011W set forth in SEQ ID NO:130, YGL084C set forth in SEQ ID NO:132, YGL104C set forth in SEQ ID NO:134, YGR224W set forth in SEQ ID NO:136, YHR032W set forth in SEQ ID NO:138, YJL093C set forth in SEQ ID NO:54, YMR034C set forth in SEQ ID NO:140, YNR055C set forth in SEQ ID NO:142, YOL020W set forth in SEQ ID NO:144, YOL075C set forth in SEQ ID NO:146, or a functional homolog thereof.

In one aspect of the recombinant host cell disclosed herein, the deletion of the gene is carried out by homologous recombination.

In one aspect, the recombinant host cell disclosed herein further comprises one or more of:
 (a) a gene encoding a geranylgeranyl diphosphate synthase (GGPPS) polypeptide;
 (b) a gene encoding an ent-copalyl diphosphate synthase (CDPS) polypeptide;
 (c) a gene encoding a kaurene oxidase (KO) polypeptide;
 (d) a gene encoding a kaurene synthase (KS) polypeptide;
 (e) a gene encoding a steviol synthase (KAH) polypeptide;
 (f) a gene encoding a cytochrome P450 reductase (CPR) polypeptide; or
 (g) a gene encoding a UGT85C2 polypeptide;
 (h) a gene encoding a UGT76G1 polypeptide;
 (i) a gene encoding a UGT74G1 polypeptide;
 (j) a gene encoding a UGT91D2 functional homolog; and/or
 (k) a gene encoding an EUGT11 polypeptide;
 wherein at least one of the genes is a recombinant gene.

In one aspect of the recombinant host cell disclosed herein:
 (a) the GGPPS polypeptide comprises a polypeptide having at least 70% identity to an amino acid sequence set forth in SEQ ID NO:182, SEQ ID NO:208, SEQ ID NO:210, SEQ ID NO:212, SEQ ID NO:214, SEQ ID NO:216, SEQ ID NO:218, or SEQ ID NO:220;
 (b) the CDPS polypeptide comprises a polypeptide having at least 70% identity to an amino acid sequence set forth in SEQ ID NO:184, SEQ ID NO:222, SEQ ID NO:224, SEQ ID NO:226, SEQ ID NO:228, or SEQ ID NO:230;
 (c) the KO polypeptide comprises a polypeptide having at least 70% identity to an amino acid sequence set forth in SEQ ID NO:188, SEQ ID NO:206, SEQ ID NO:246, SEQ ID NO:249, SEQ ID NO:251, SEQ ID NO:253, SEQ ID NO:255, SEQ ID NO:257, SEQ ID NO:259, or SEQ ID NO:261;
 (d) the KS polypeptide comprises a polypeptide having at least 70% identity to an amino acid sequence set forth in SEQ ID NO:186, SEQ ID NO:232, SEQ ID NO:234, SEQ ID NO:236, SEQ ID NO:238;
 (e) the KAH polypeptide comprises a polypeptide having at least 70% identity to an amino acid sequence set forth in SEQ ID NO:192, SEQ ID NO:266, SEQ ID NO:269, SEQ ID NO:270, SEQ ID NO:271, SEQ ID NO:272, SEQ ID NO:273, SEQ ID NO:275, SEQ ID NO:277, SEQ ID NO:279, SEQ ID NO:281, or SEQ ID NO:283;
 (f) the CPR polypeptide comprises a polypeptide having at least 70% identity to an amino acid sequence set forth in SEQ ID NO:190, SEQ ID NO:194, SEQ ID NO:263, SEQ ID NO:265, SEQ ID NO:287, SEQ ID NO:289, SEQ ID NO:291, or SEQ ID NO:293;
 (g) the UGT85C2 polypeptide comprises a polypeptide having at least 55% identity to an amino acid sequence set forth in SEQ ID NO:196;
 (h) the UGT76G1 polypeptide comprises a polypeptide having at least 50% identity to an amino acid sequence set forth in SEQ ID NO:200;
 (i) the UGT74G1 polypeptide comprises a polypeptide having at least 55% identity to an amino acid sequence set forth in SEQ ID NO:198;
 (j) the UGT91D2 functional homolog comprises a UGT91D2e-b polypeptide having at least 90% identity to the amino acid sequence set forth in SEQ ID NO:202; and/or
 (k) the EUGT11 polypeptide comprises a polypeptide having at least 65% identity to an amino acid sequence set forth in SEQ ID NO:204.

In one aspect, the recombinant host cell disclosed herein comprises a plant cell, a mammalian cell, an insect cell, a fungal cell, or a bacterial cell.

In one aspect of the recombinant host cell disclosed herein, the bacterial cell comprises *Escherichia* bacteria cells, *Lactobacillus* bacteria cells, *Lactococcus* bacteria cells, *Cornebacterium* bacteria cells, *Acetobacter* bacteria cells, *Acinetobacter* bacteria cells, or *Pseudomonas* bacterial cells.

In one aspect of the recombinant host cell disclosed herein, the fungal cell comprises a yeast cell.

In one aspect of the recombinant host cell disclosed herein, the yeast cell is a cell from *Saccharomyces cerevisiae*, *Schizosaccharomyces pombe*, *Yarrowia lipolytica*, *Candida glabrata*, *Ashbya gossypii*, *Cyberlindnera jadinii*, *Pichia pastoris*, *Kluyveromyces lactis*, *Hansenula polymorpha*, *Candida boidinii*, *Arxula adeninivorans*, *Xanthophyllomyces dendrorhous*, or *Candida albicans* species.

In one aspect of the recombinant host cell disclosed herein, the yeast cell is a *Saccharomycete*.

In one aspect of the recombinant host cell disclosed herein, the yeast cell is a cell from the *Saccharomyces cerevisiae* species.

In one aspect of the recombinant host cell disclosed herein, the recombinant host cell excretes a decreased amount of steviol-13-O-glucoside (13-SMG) relative to a steviol glycoside-producing host that does not have modified expression of a transporter gene.

In one aspect of the recombinant host cell disclosed herein, the recombinant host cell excretes an increased amount of RebA, RebB, RebD, and/or RebM relative to a steviol glycoside-producing host that does not have modified expression of a transporter gene.

In one aspect of the recombinant host cell disclosed herein, the recombinant host cell produces an increased amount of RebA, RebB, RebD, and/or RebM relative to a steviol glycoside-producing host that does not have modified expression of a transporter gene.

The invention further provides a method of increasing production of a steviol glycoside in a recombinant host cell or increasing excretion of a steviol glycoside into a culture medium, comprising growing the recombinant host cell of any one of claims 1-21 in a cell culture broth, under conditions in which the genes are expressed;
wherein the steviol glycoside is produced by the recombinant host cell.

In one aspect of the method disclosed herein, the steviol glycoside is RebA, RebB, RebD and/or RebM.

The invention further provides a method of increasing production of RebA, RebB, RebD, and/or RebM comprising:
growing the recombinant host cell disclosed herein in a cell culture broth;
wherein excretion of 13-SMG from the recombinant host cell into the cell culture broth is decreased;
wherein RebA, RebB, RebD, and/or RebM are produced by the recombinant host cell.

In one aspect of the method disclosed herein, the method further comprises isolating RebA, RebB, RebD, and/or RebM, alone or in combination.

In one aspect of the method disclosed herein, the isolating step comprises:
(a) providing the cell culture broth comprising RebA, RebB, RebD, and/or RebM;
(b) separating a liquid phase of the cell culture broth from a solid phase of the cell culture broth to obtain a supernatant comprising RebA, RebB, RebD, and/or RebM;
(c) providing one or more adsorbent resins, comprising providing the adsorbent resins in a packed column; and
(d) contacting the supernatant of step (b) with the one or more adsorbent resins in order to obtain at least a portion of RebA, RebB, RebD, and/or RebM, thereby isolating RebA, RebB, RebD, and/or RebM.

In one aspect of the method disclosed herein, the isolating step comprises:
(a) providing the cell culture broth comprising RebA, RebB, RebD, and/or RebM;
(b) separating a liquid phase of the cell culture broth from a solid phase of the cell culture broth to obtain a supernatant comprising RebA, RebB, RebD, and/or RebM;
(c) providing one or more ion exchange or ion exchange or reversed-phase chromatography columns; and
(d) contacting the supernatant of step (b) with the one or more ion exchange or ion exchange or reversed-phase chromatography columns in order to obtain at least a portion of RebA, RebB, RebD, and/or RebM.

In one aspect of the method disclosed herein, the isolating step comprises:
(a) providing the cell culture broth comprising RebA, RebB, RebD, and/or RebM;
(b) separating a liquid phase of the cell culture broth from a solid phase of the cell culture broth to obtain a supernatant comprising RebA, RebB, RebD, and/or RebM; and
(c) crystallizing or extracting RebA, RebB, RebD, and/or RebM, thereby isolating RebA, RebB, RebD, and/or RebM.

In one aspect of the method disclosed herein, the method further comprises recovering RebA, RebB, RebD, and/or RebM alone or a composition comprising RebA, RebB, RebD, and/or RebM.

In one aspect of the method disclosed herein, the recovered composition is enriched for RebA, RebB, RebD, and/or RebM, relative to a glycoside composition of *Stevia* plant and has a reduced level of non-glycoside *Stevia* plant-derived components relative to a plant-derived *stevia* extract.

In one aspect of the method disclosed herein, the recovered composition has a reduced level of non-glycoside *Stevia* plant-derived components relative to a plant-derived *stevia* extract.

In one aspect of the method disclosed herein, the cell culture broth comprises:
(a) one or more RebA, RebB, RebD, and/or RebM produced by the recombinant host cell disclosed herein;
(b) glucose, fructose, and/or sucrose; and/or
(c) supplemental nutrients comprising trace metals, vitamins, salts, yeast nitrogen base (YNB), and/or amino acids.

The invention further provides a culture broth comprising:
(a) the recombinant host cell disclosed herein; and
(b) one or more RebA, RebB, RebD, and/or RebM;
wherein one or more RebA, RebB, RebD, and/or RebM is present at a concentration of at least 0.1 mg/liter of the culture broth.

The invention further provides a culture broth comprising:
(a) the recombinant host cell disclosed herein; and
(b) one or more RebA, RebB, RebD, and/or RebM produced by the recombinant host cell disclosed herein,
wherein one or more RebA, RebB, RebD, and/or RebM is present at a concentration of at least 0.1 mg/liter of the culture broth and the cell culture broth further comprises glucose, UDP-glucose, UDP-rhamnose, UDP-xylose, N-acetyl-glucosamine, and/or YNB.

The invention further provides a culture broth comprising:
(a) the recombinant host cell disclosed herein; and
(b) one or more RebA, RebB, RebD, and/or RebM produced by the recombinant host cell disclosed herein,
wherein one or more RebA, RebB, RebD, and/or RebM is present at a concentration of at least 0.1 mg/liter of the culture broth and the cell culture broth further comprises glucose, UDP-glucose, UDP-rhamnose, UDP-xylose, N-acetyl-glucosamine, and/or YNB;
wherein the cell culture broth has a reduced level of non-steviol glycoside *Stevia* plant-derived components relative to a plant-derived *stevia* extract.

The invention further provides a culture broth comprising:
(a) the recombinant host cell disclosed herein; and
(b) one or more RebA, RebB, RebD, and/or RebM produced by the recombinant host cell disclosed herein,
wherein one or more RebA, RebB, RebD, and/or RebM is present at a concentration of at least 0.1 mg/liter of the culture broth and the cell culture broth further comprises glucose, UDP-glucose, UDP-rhamnose, UDP-xylose, N-acetyl-glucosamine, and/or YNB;
wherein the cell culture broth is enriched for the RebD and/or RebM relative to a steviol glycoside extract of Stevia plant and has a reduced level of non-steviol glycoside Stevia plant-derived components relative to a plant-derived stevia extract.

The invention further provides a cell lysate comprising one or more RebA, RebB, RebD, and/or RebM produced by the recombinant host cell disclosed herein, and the cell lysate further comprises glucose, UDP-glucose, UDP-rhamnose, UDP-xylose, N-acetyl-glucosamine, and/or YNB.

The invention further provides RebA, RebB, RebD, and/or RebM produced by the recombinant host cell disclosed herein.

The invention further provides RebA, RebB, RebD, and/or RebM produced by the method disclosed herein.

The invention further provides a sweetener composition, comprising RebA, RebB, RebD, and/or RebM produced herein.

The invention further provides a food product comprising, comprising the sweetener composition disclosed herein.

The invention further provides a beverage or a beverage concentrate, comprising the sweetener composition disclosed herein.

These and other features and advantages of the present invention will be more fully understood from the following detailed description of the invention taken together with the accompanying claims. It is noted that the scope of the claims is defined by the recitations therein and not by the specific discussion of features and advantages set forth in the present description.

DESCRIPTION OF DRAWINGS

The following detailed description of the embodiments of the present invention can be best understood when read in conjunction with the following drawings, where like structure is indicated with like reference numerals and in which:

FIGS. 2C and 2H shows levels of RebD (total levels and supernatant levels; $\mu M/OD_{600}$)

FIG. 3A shows levels of 13-SMG (total levels and supernatant levels; $\mu M/OD_{600}$)

Figure 1:
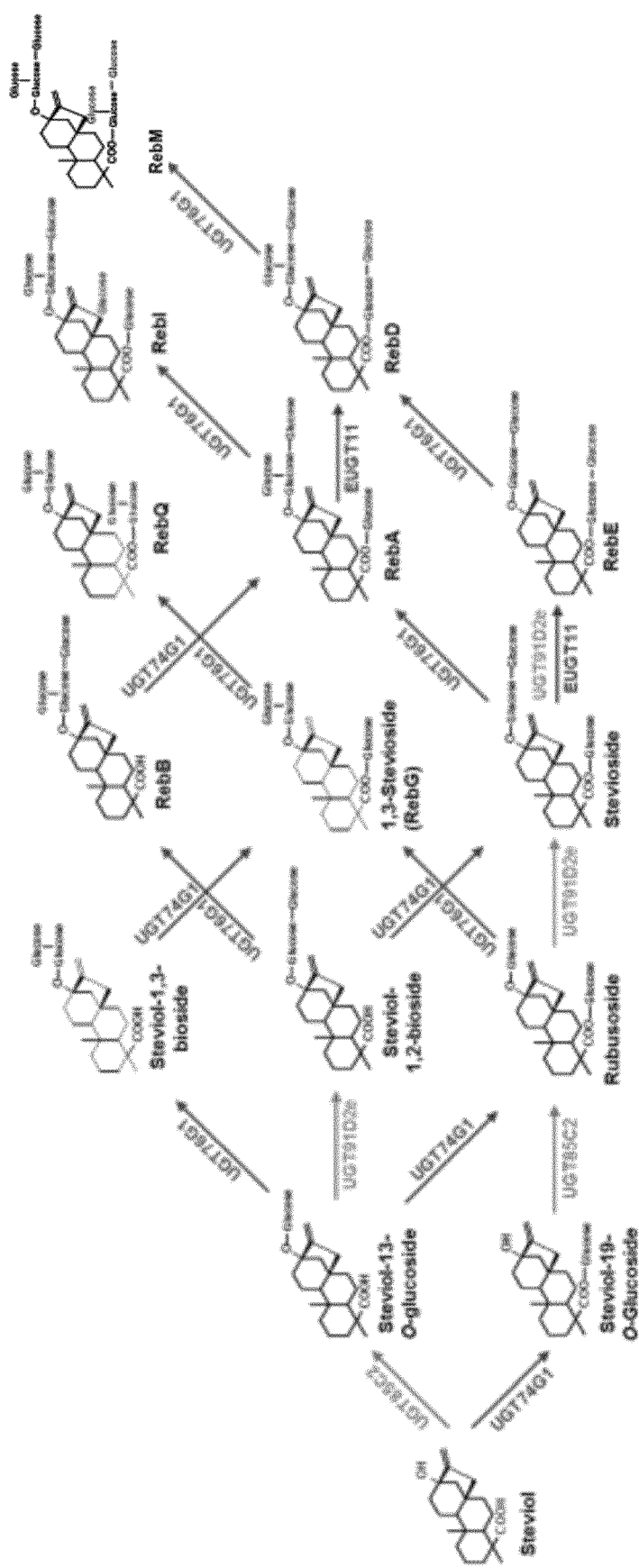
FIG. 1 shows representative primary steviol glycoside glycosylation reactions catalyzed by suitable UGT enzymes and chemical structures for several steviol glycoside compounds.
Figure 2A:
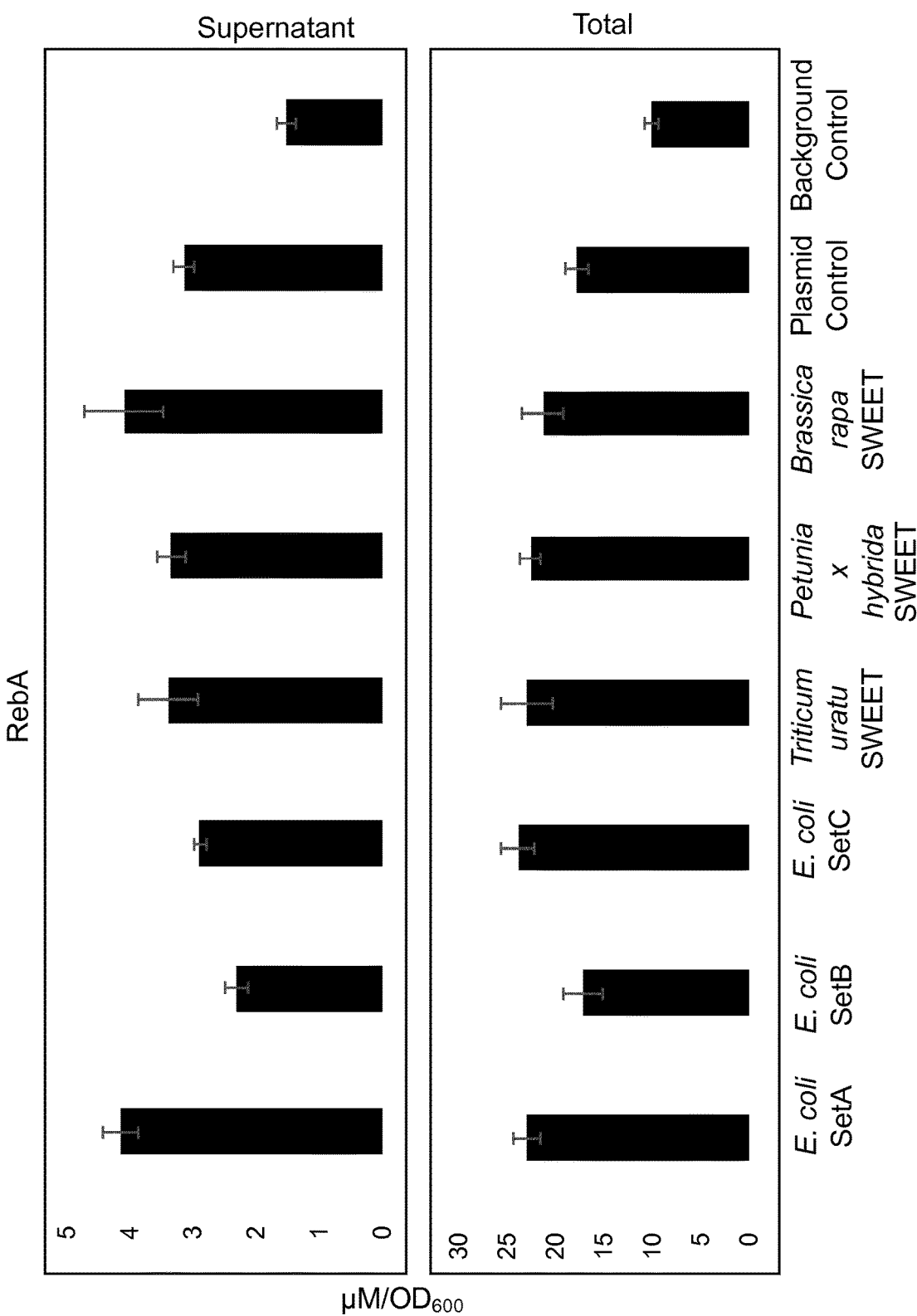
FIGS. 2A and 2F show levels of RebA (total levels and supernatant levels; $\mu M/OD_{600}$)
Figure 2B:
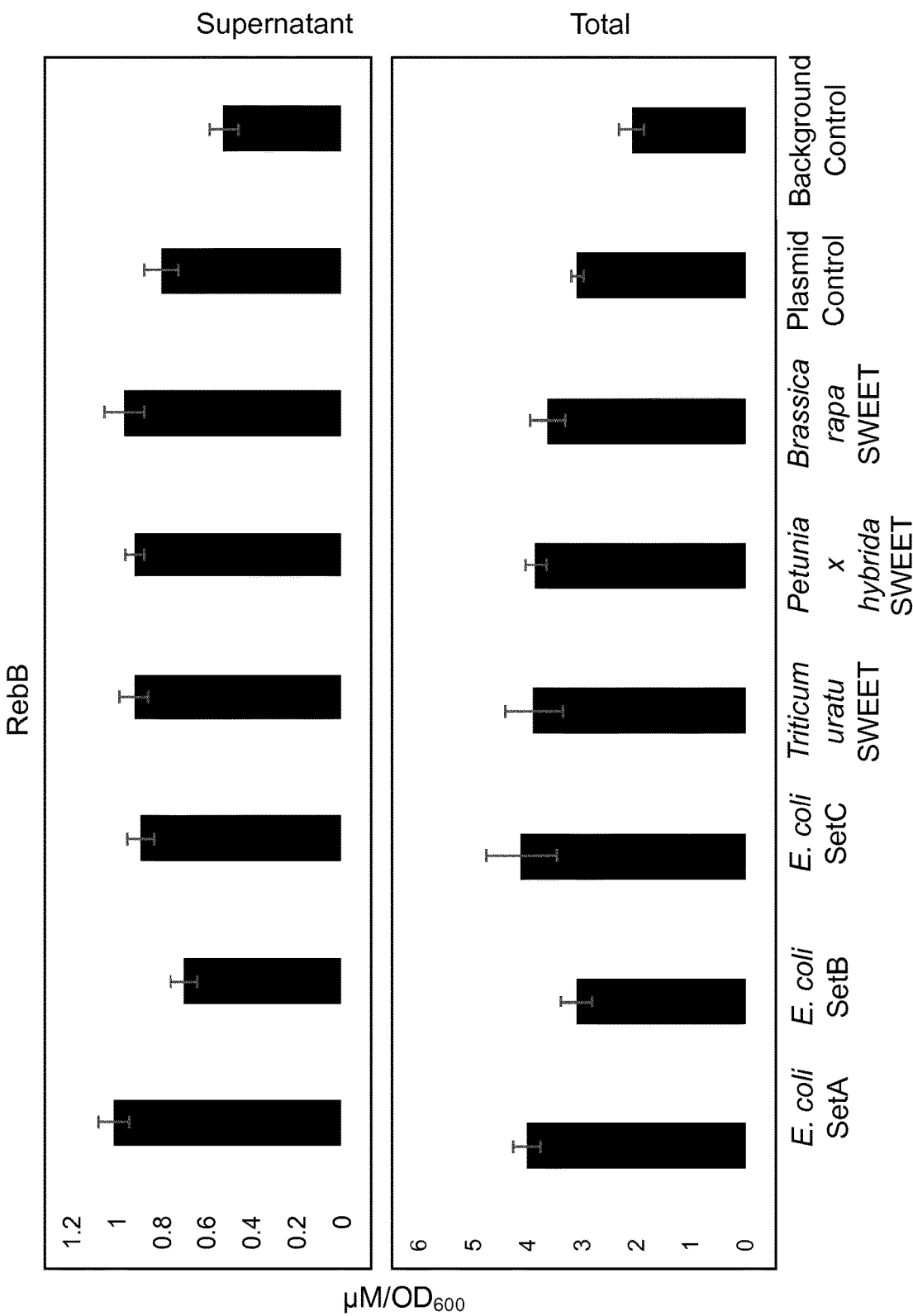
FIGS. 2B and 2G show levels of RebB (total levels and supernatant levels; $\mu M/OD_{600}$)
Figure 2C:
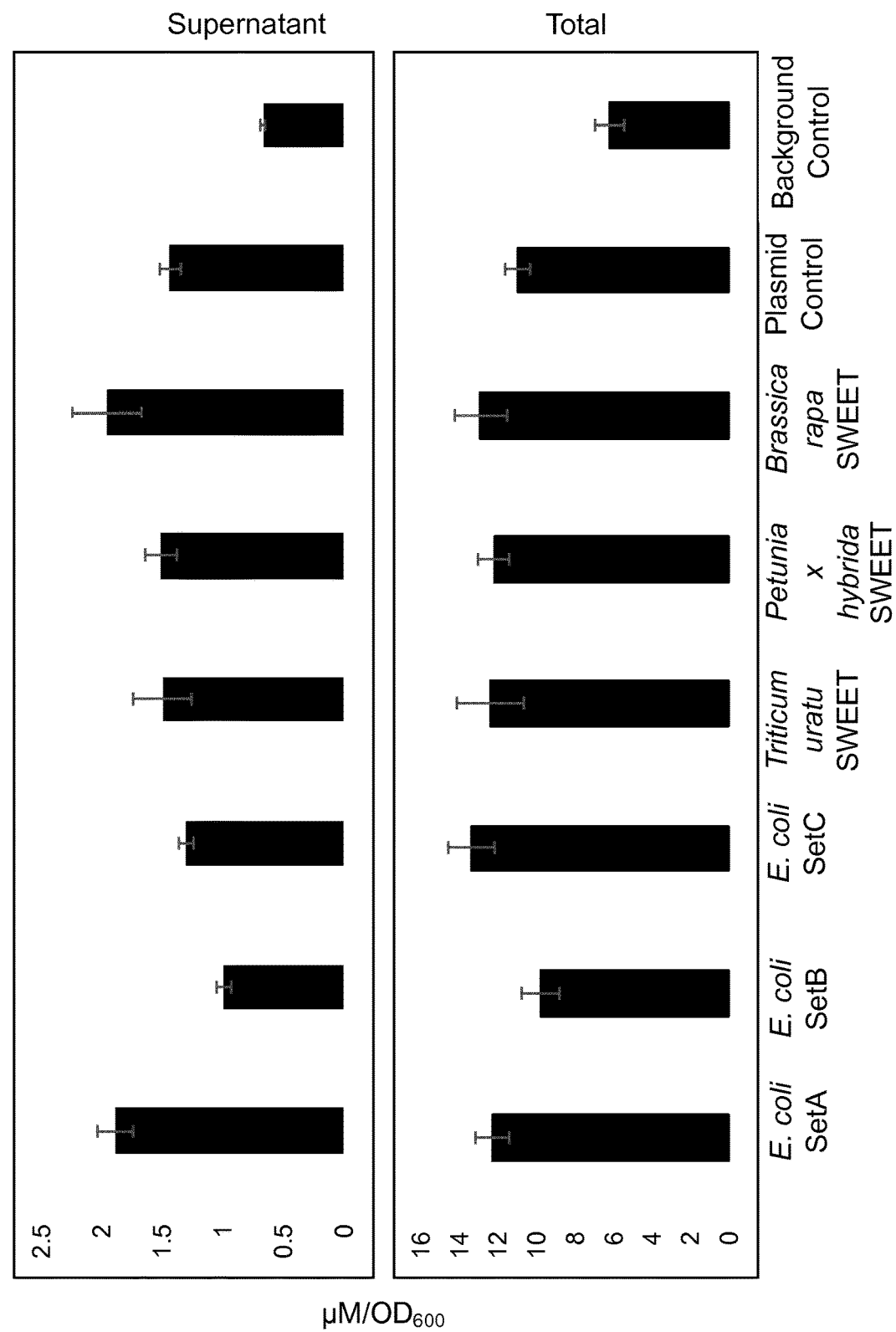
Figure 2D:
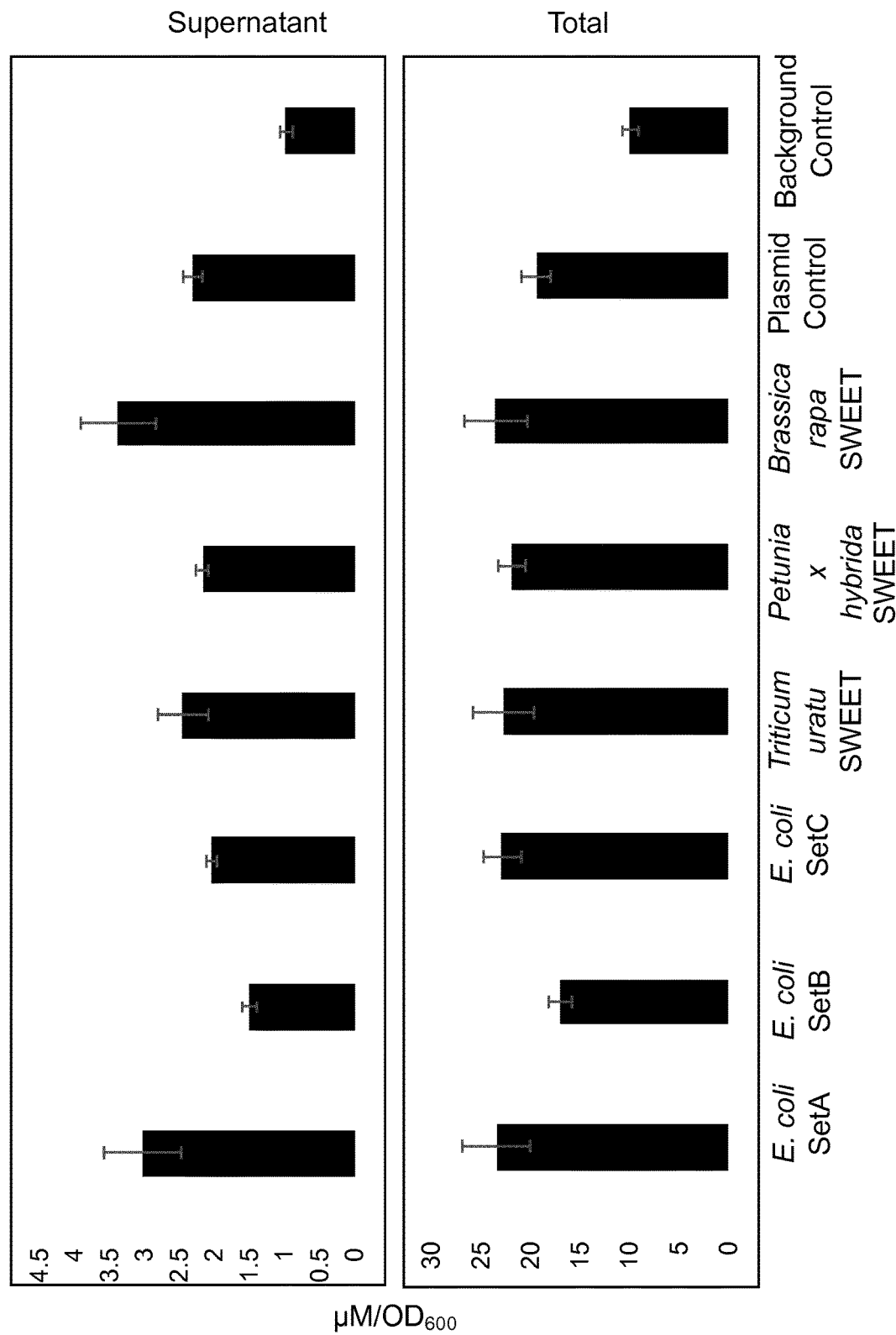
FIGS. 2D and 2I shows levels of RebM (total levels and supernatant levels; $\mu M/OD_{600}$)
Figure 2E:
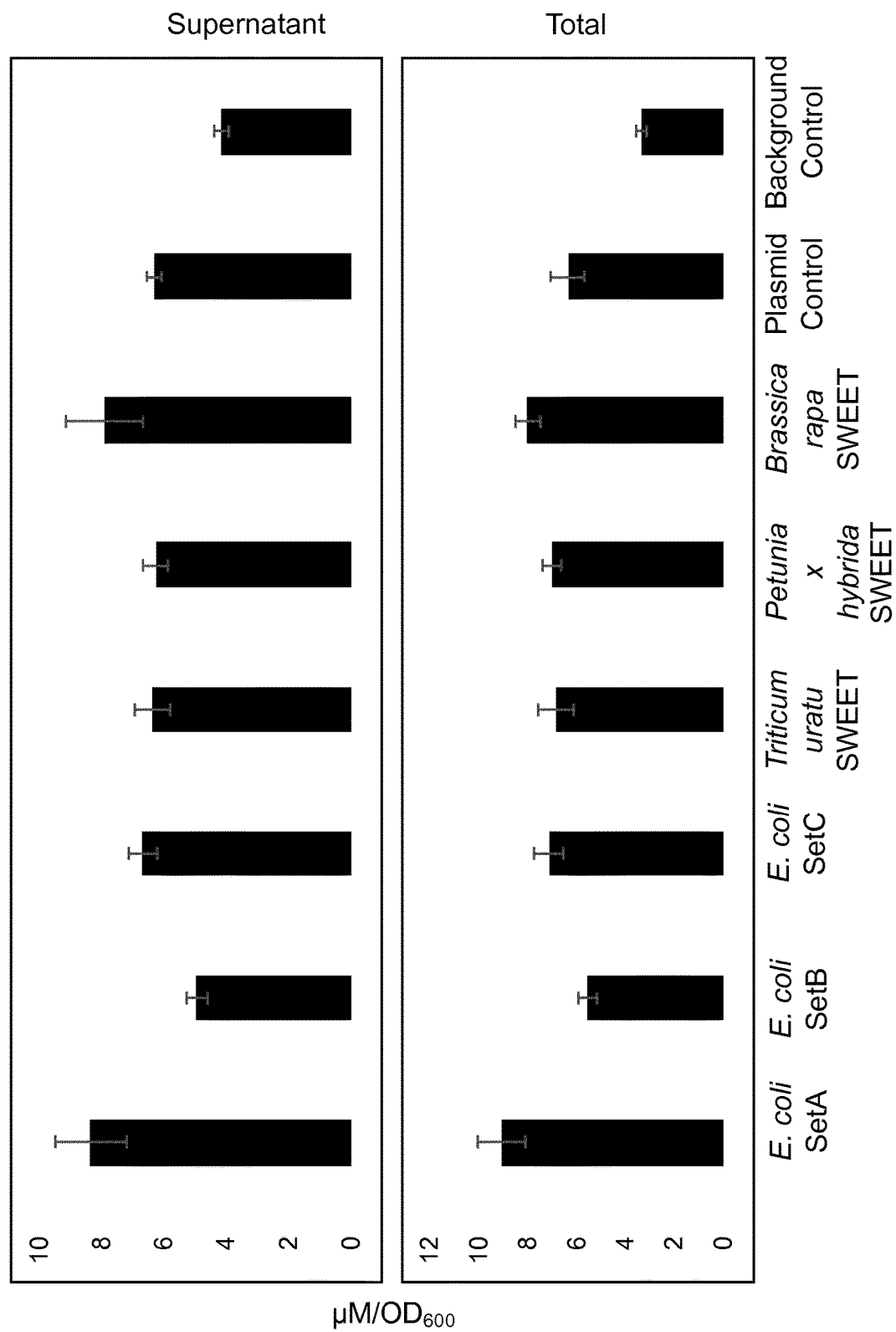
FIG. 2E shows levels of steviol-13-O-glucoside (13-SMG) (total levels and supernatant levels; $\mu M/OD_{600}$) produced by steviol glycoside-producing S. cerevisiae strains transformed with plasmids carrying Sugar Efflux Transporter A (SetA) polypeptide from E. coli (SEQ ID NO:17, SEQ ID NO:18), Sugar Efflux Transporter B (SetB) polypeptide from E. coli (SEQ ID NO:19, SEQ ID NO:20), Sugar Efflux Transporter C (SetC) polypeptide from E. coli (SEQ ID NO:21, SEQ ID NO:22), Sugar Transporter SWEET (SWEET) polypeptide from Brassica rapa (SEQ ID NO:23, SEQ ID NO:24), SWEET polypeptide from Petunia×hybrid (SEQ ID NO:25, SEQ ID NO:26), or SWEET from Triticum urartu (SEQ ID NO:27, SEQ ID NO:28). The steviol glycoside-producing S. cerevisiae strains in FIG. 2 comprised a recombinant gene encoding a Synechococcus sp. GGPPS7 polypeptide (SEQ ID NO:181, SEQ ID NO:182), a recombinant gene encoding a truncated Zea mays CDPS polypeptide (SEQ ID NO:183, SEQ ID NO:184), a recombinant gene encoding an A. thaliana KS5 polypeptide (SEQ ID NO:185, SEQ ID NO:186), a recombinant gene encoding a recombinant S. rebaudiana KO1 polypeptide (SEQ ID NO:187, SEQ ID NO:188), a recombinant gene encoding an A. thaliana ATR2 polypeptide (SEQ ID NO:189, SEQ ID NO:190), a recombinant gene encoding an SrKAHe1 polypeptide (SEQ ID NO:191, SEQ ID NO:192), a recombinant gene encoding an S. rebaudiana CPR8 polypeptide (SEQ ID NO:193, SEQ ID NO:194), a recombinant gene encoding an S. rebaudiana UGT85C2 polypeptide (SEQ ID NO:195, SEQ ID NO:196), a recombinant gene encoding an S. rebaudiana UGT74G1 polypeptide (SEQ ID NO:197, SEQ ID NO:198), a recombinant gene encoding an S. rebaudiana UGT76G1 polypeptide (SEQ ID NO:199, SEQ ID NO:200), a recombinant gene encoding an S. rebaudiana UGT91D2e-b polypeptide (SEQ ID NO:201, SEQ ID NO:202), and a recombinant gene encoding an O. sativa EUGT11 (SEQ ID NO:203, SEQ ID NO:204) polypeptide but differ in the copy number of the genes. The steviol glycoside-producing S. cerevisiae strain in FIGS. 2F-2I comprised a higher copy number of the above-described genes, compared to the strain in FIGS. 2A-2E. See Example 2.
Figure 2F:
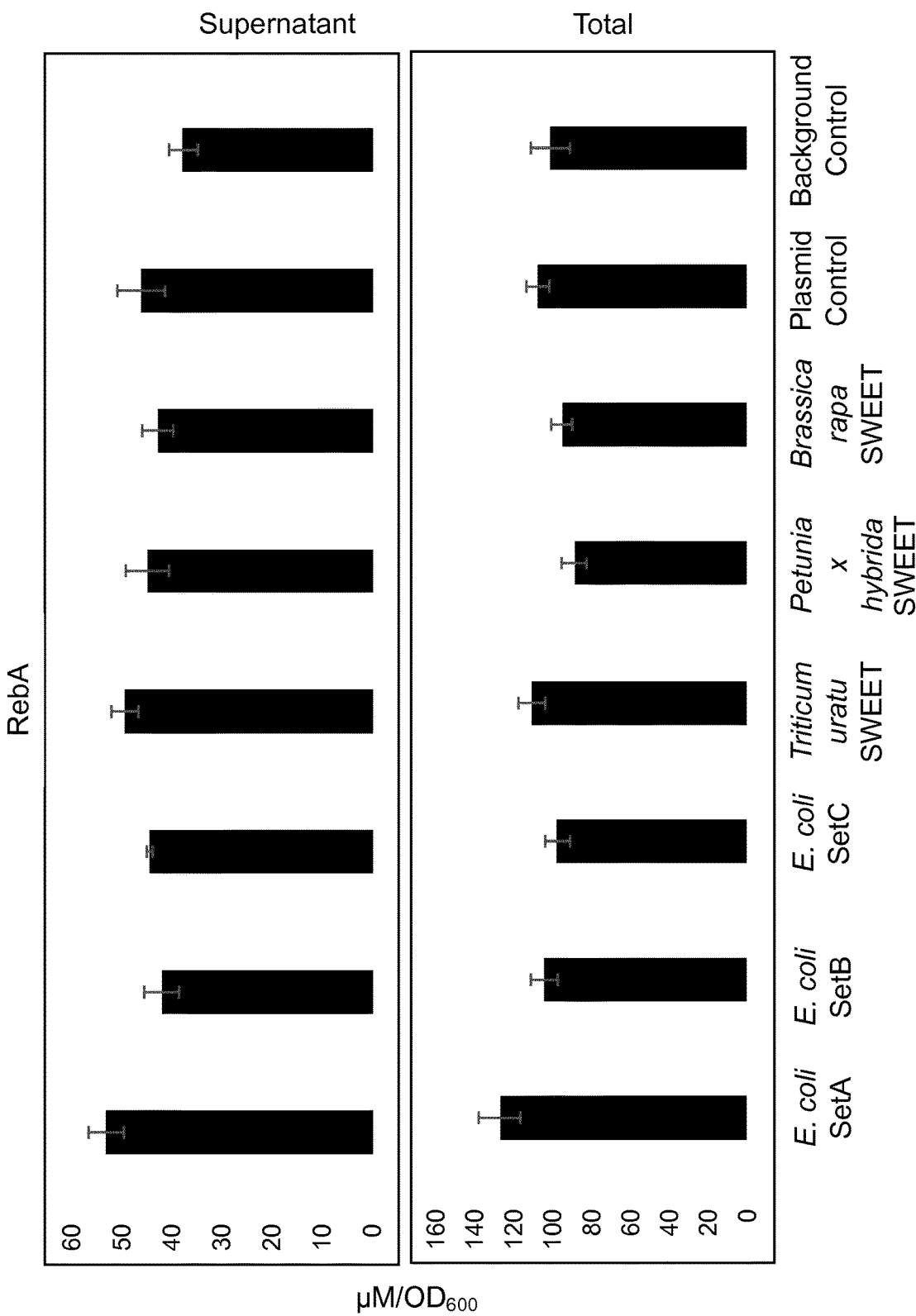
Figure 2G:
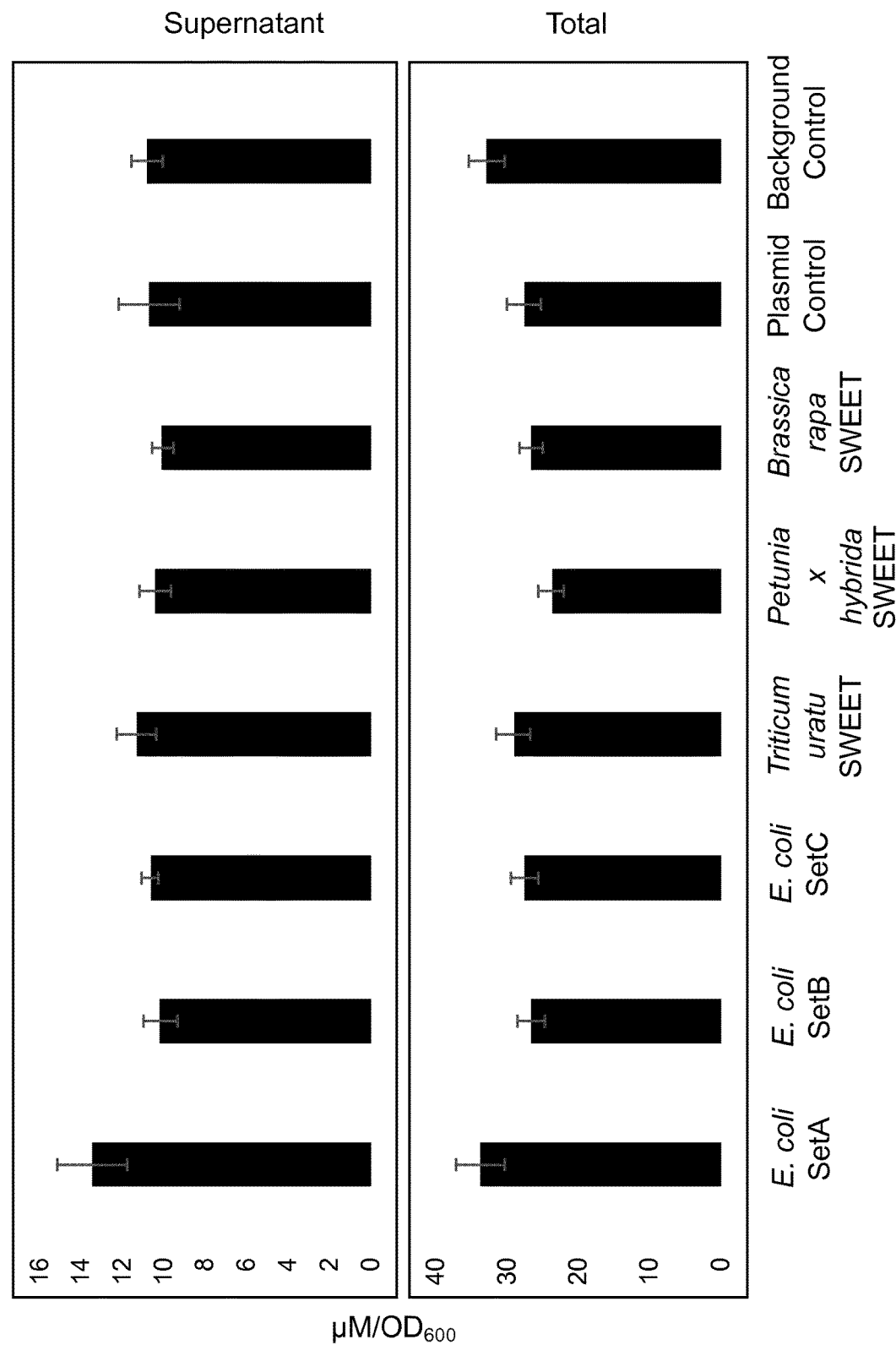
Figure 2I:
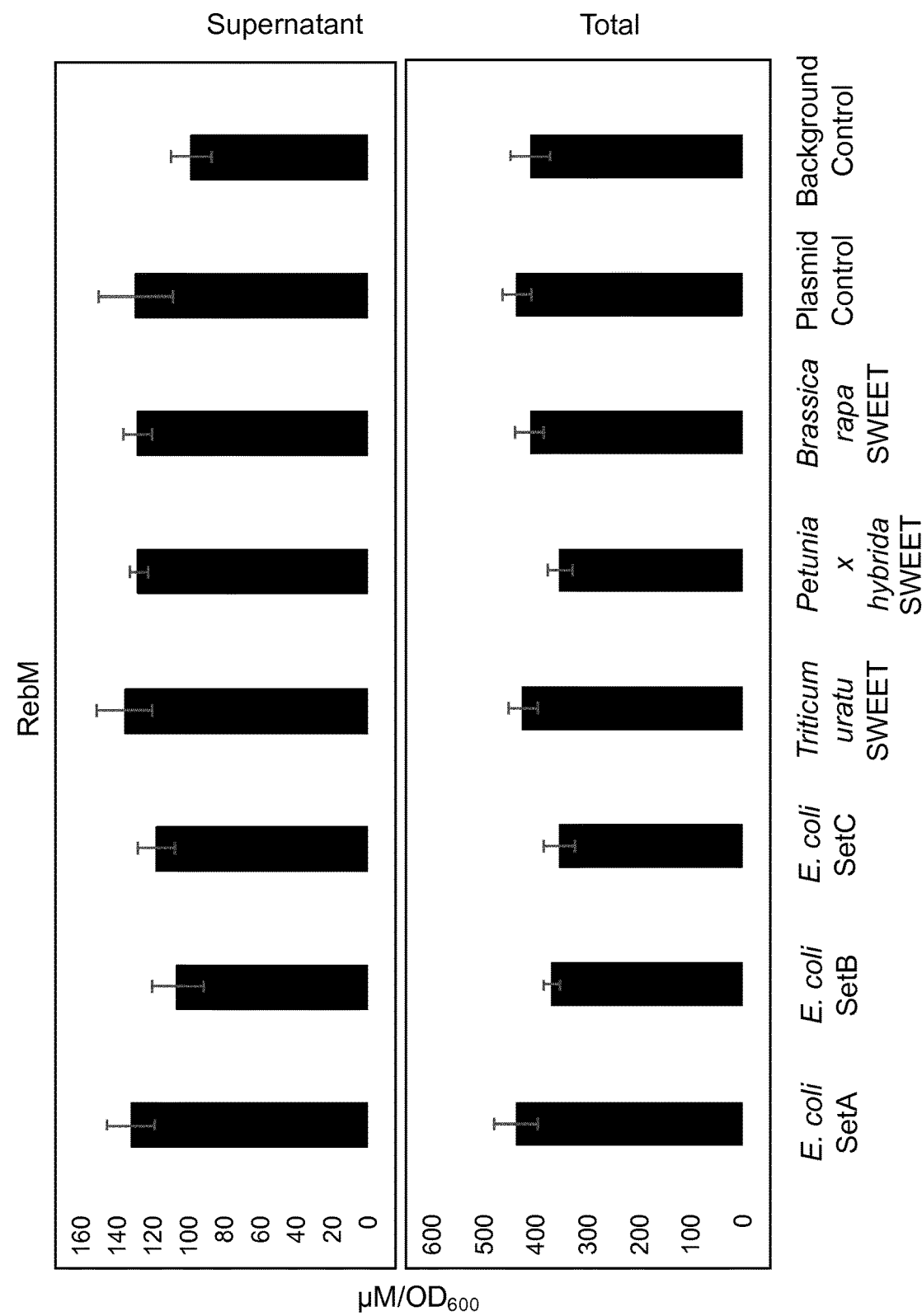
Figure 3B:
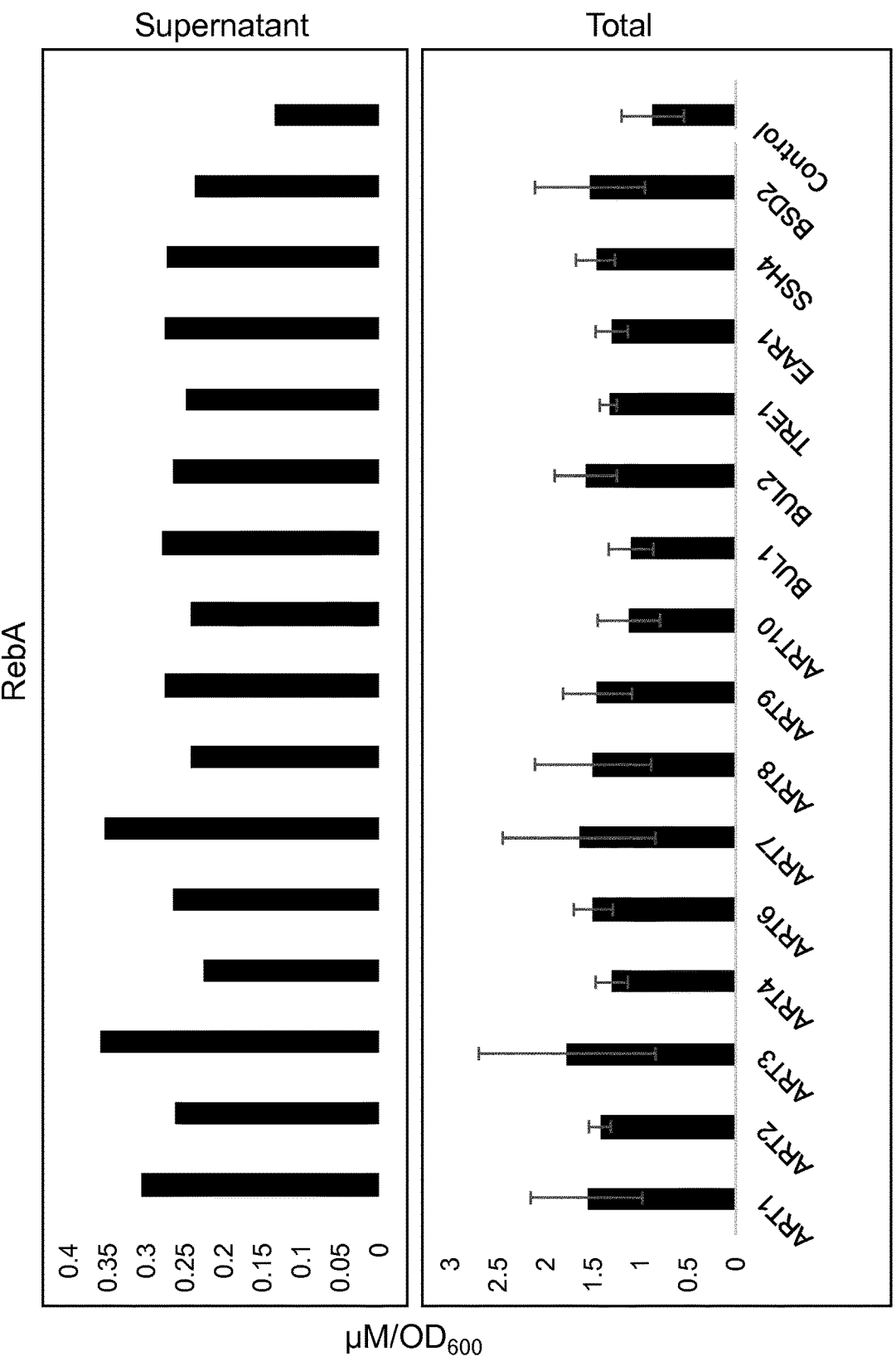
FIG. 3B shows levels of RebA (total levels and supernatant levels; $\mu M/OD_{600}$)
Figure 3C:
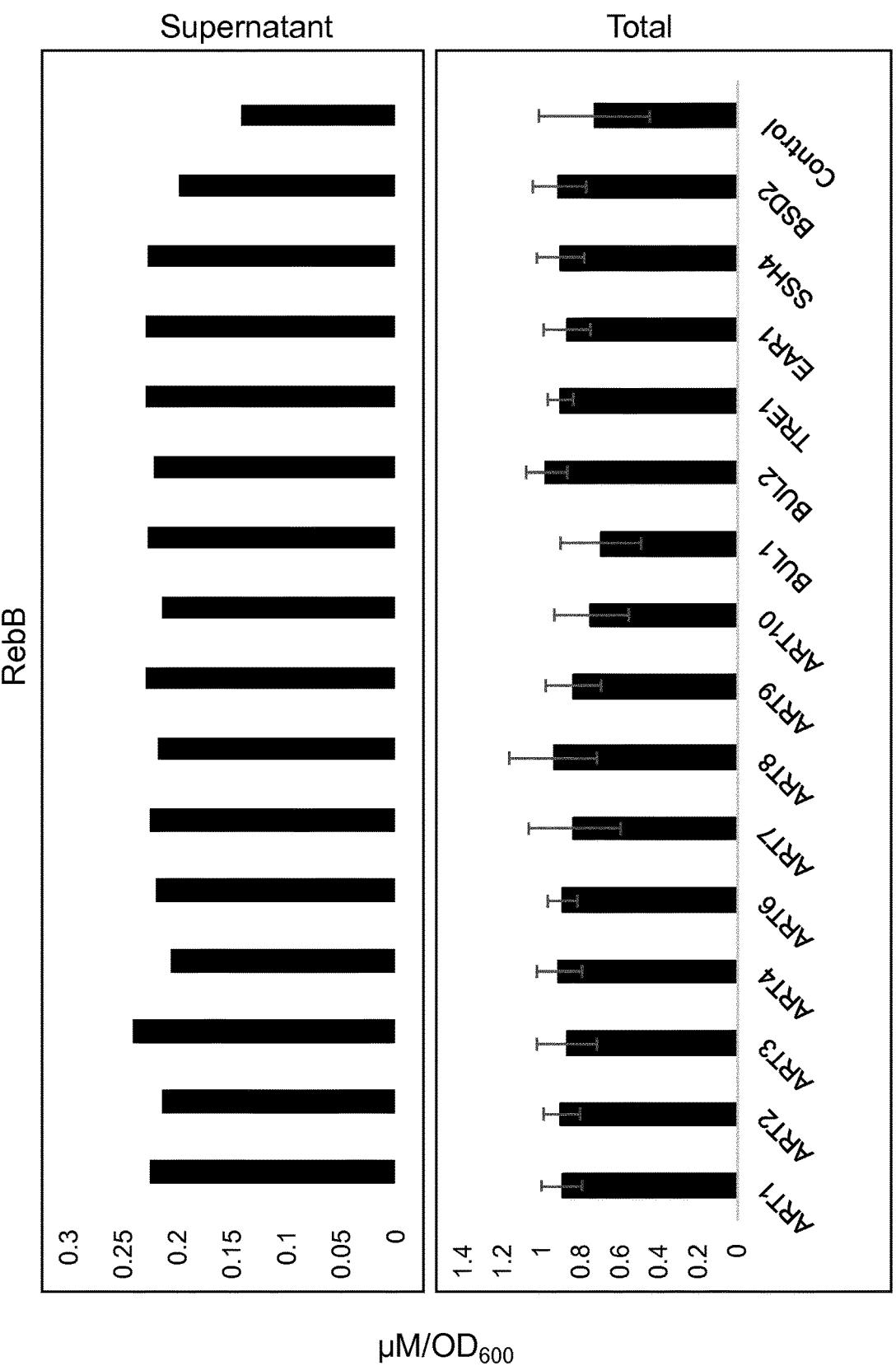
FIG. 3C shows levels of RebB (total levels and supernatant levels; $\mu M/OD_{600}$)
Figure 3D:
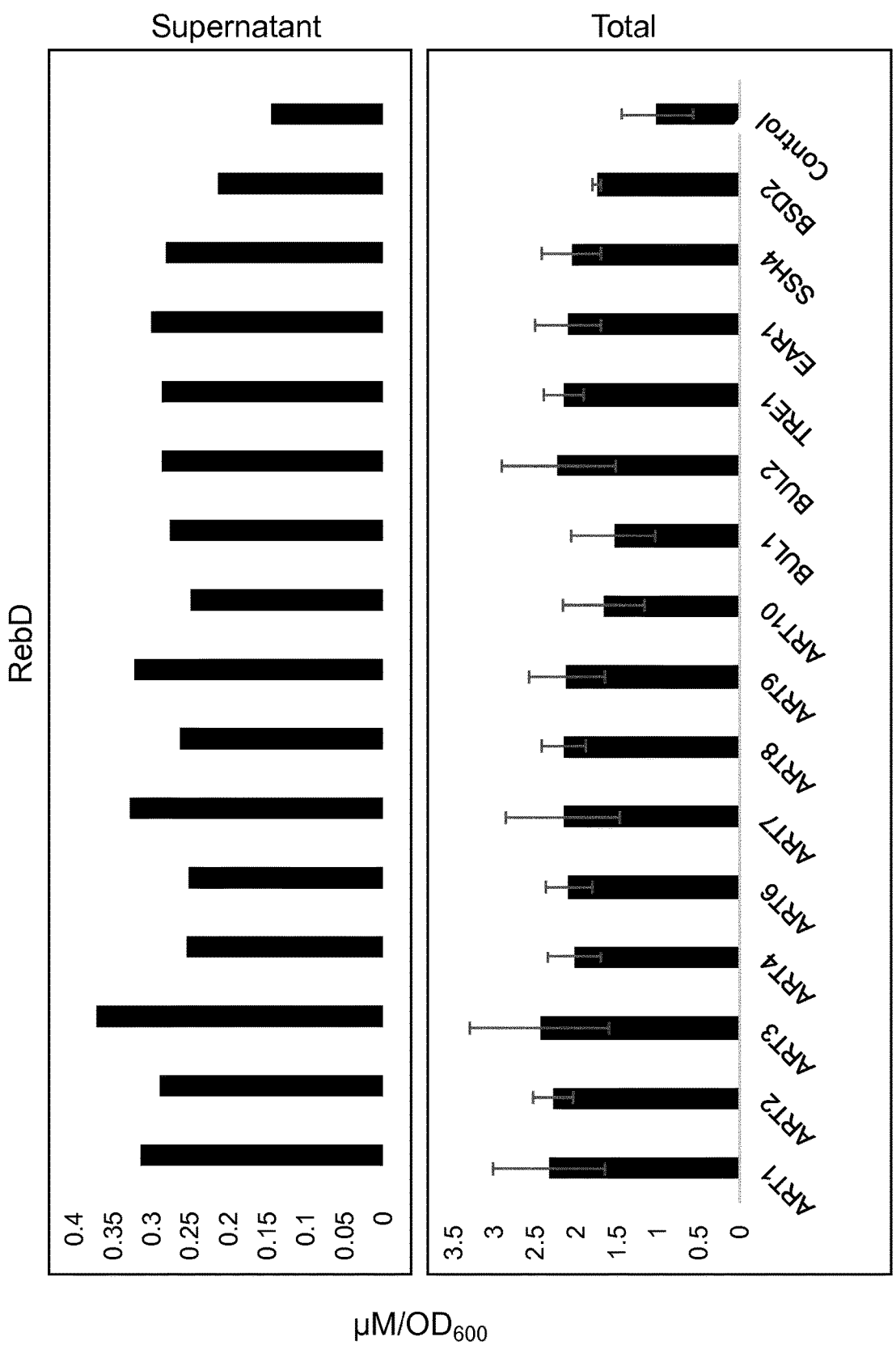
FIG. 3D shows levels of RebD (total levels and supernatant levels; $\mu M/OD_{600}$)
Figure 3E:
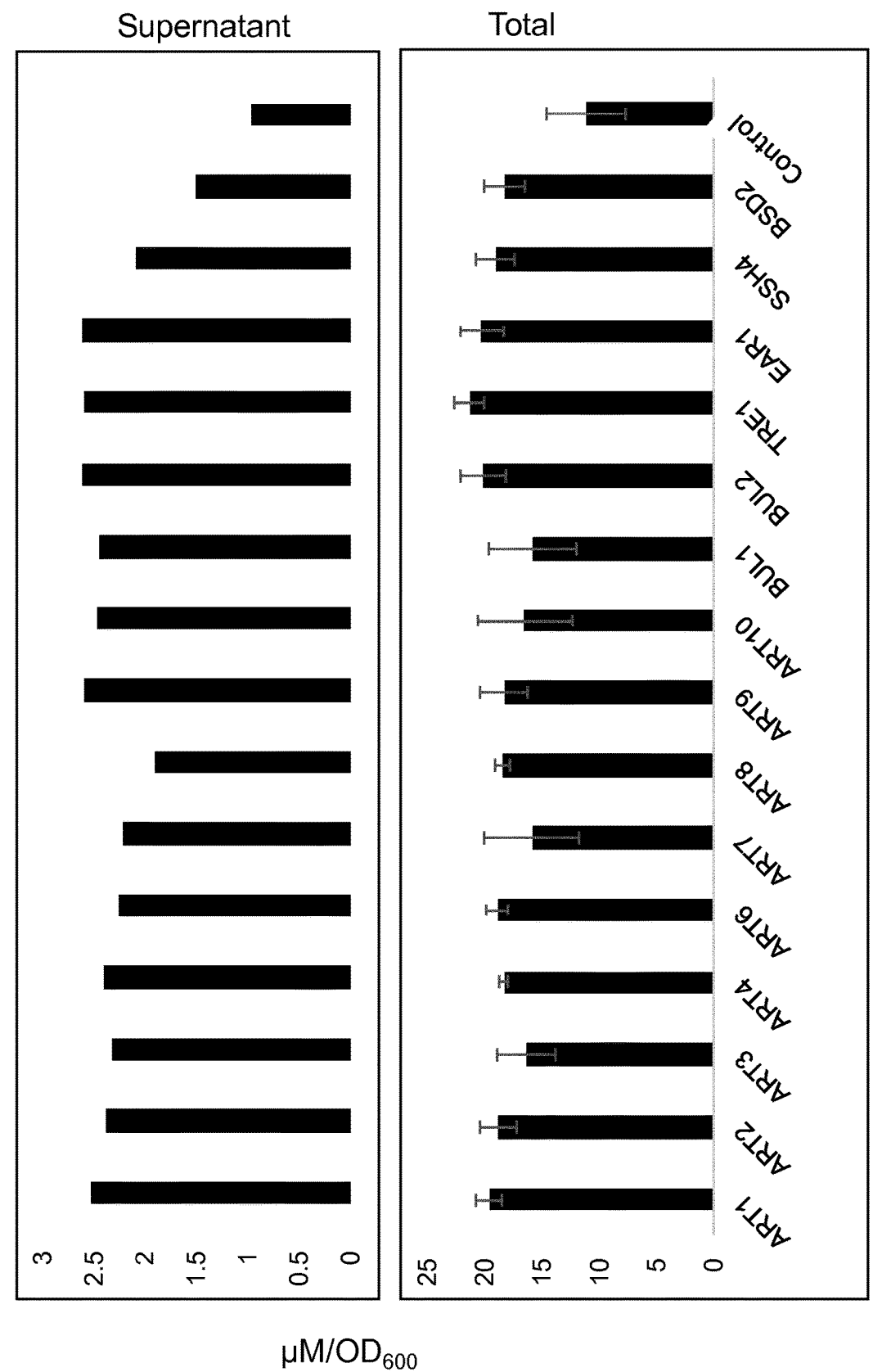
FIG. 3E shows levels of RebM (total levels and supernatant levels; $\mu M/OD_{600}$) in a steviol glycoside-producing S. cerevisiae strain deleted of adapter proteins Art1 (SEQ ID NO:31, SEQ ID NO:32), Art2 (SEQ ID NO:34), Art3 (SEQ ID NO:35, SEQ ID NO:36), Art4 (SEQ ID NO:37, SEQ ID NO:38), Art6 (SEQ ID NO:39, SEQ ID NO:40), Art7 (SEQ ID NO:41, SEQ ID NO:42), Art8 (SEQ ID NO:43, SEQ ID NO:44), Art9 (SEQ ID NO:165, SEQ ID NO:166), Art10 (SEQ ID NO:29, SEQ ID NO:30), Bul1 (SEQ ID NO:45, SEQ ID NO:46), Bul2 (SEQ ID NO:47, SEQ ID NO:48), Tre1 (SEQ ID NO:173, SEQ ID NO:174), Ear1 (SEQ ID NO:169, SEQ ID NO:170), Ssh4 (SEQ ID NO:171, SEQ ID NO:172), or Bsd2 (SEQ ID NO:167, SEQ ID NO:168). See Example 3.

Skilled artisans will appreciate that elements in the Figures are illustrated for simplicity and clarity and have not necessarily been drawn to scale. For example, the dimensions of some of the elements in the Figures can be exaggerated relative to other elements to help improve understanding of the embodiment(s) of the present invention.

DETAILED DESCRIPTION

All publications, patents and patent applications cited herein are hereby expressly incorporated by reference in their entirety for all purposes.

Before describing the present invention in detail, a number of terms will be defined. As used herein, the singular forms "a," "an," and "the" include plural referents unless the context clearly dictates otherwise. For example, reference to "a nucleic acid" means one or more nucleic acids.

It is noted that terms like "preferably," "commonly," and "typically" are not utilized herein to limit the scope of the claimed invention or to imply that certain features are critical, essential, or even important to the structure or function of the claimed invention. Rather, these terms are merely intended to highlight alternative or additional features that can or cannot be utilized in a particular embodiment of the present invention.

For the purposes of describing and defining the present invention it is noted that the term "substantially" is utilized herein to represent the inherent degree of uncertainty that can be attributed to any quantitative comparison, value, measurement, or other representation. The term "substantially" is also utilized herein to represent the degree by which a quantitative representation can vary from a stated reference without resulting in a change in the basic function of the subject matter at issue.

Methods well known to those skilled in the art can be used to construct genetic expression constructs and recombinant cells according to this invention. These methods include in vitro recombinant DNA techniques, synthetic techniques, in vivo recombination techniques, and polymerase chain reaction (PCR) techniques. See, for example, techniques as described in Green & Sambrook, 2012, MOLECULAR CLONING: A LABORATORY MANUAL, Fourth Edition, Cold Spring Harbor Laboratory, New York; Ausubel et al., 1989, CURRENT PROTOCOLS IN MOLECULAR BIOLOGY, Greene Publishing Associates and Wiley Interscience, New York, and PCR Protocols: A Guide to Methods and Applications (Innis et al., 1990, Academic Press, San Diego, Calif.).

As used herein, the terms "polynucleotide," "nucleotide," "oligonucleotide," and "nucleic acid" can be used interchangeably to refer to nucleic acid comprising DNA, RNA, derivatives thereof, or combinations thereof.

As used herein, the terms "microorganism," "microorganism host," "microorganism host cell," "host cell," "recombinant host," "recombinant microorganism host," and "recombinant host cell" can be used interchangeably. As used herein, the term "recombinant host" is intended to refer to a host, the genome of which has been augmented by at least one DNA sequence. Such DNA sequences include but are not limited to genes that are not naturally present, DNA sequences that are not normally transcribed into RNA or translated into a protein ("expressed"), and other genes or DNA sequences which one desires to introduce into the non-recombinant host. It will be appreciated that typically the genome of a recombinant host described herein is augmented through stable introduction of one or more recombinant genes. Generally, introduced DNA is not originally resident in the host that is the recipient of the DNA, but it is within the scope of this disclosure to isolate a DNA segment from a given host, and to subsequently introduce one or more additional copies of that DNA into the same host, e.g., to enhance production of the product of a gene or alter the expression pattern of a gene. In some instances, the introduced DNA will modify or even replace an endogenous gene or DNA sequence by, e.g., homologous recombination or site-directed mutagenesis. Suitable recombinant hosts include microorganisms.

As used herein, the term "recombinant gene" refers to a gene or DNA sequence that is introduced into a recipient host, regardless of whether the same or a similar gene or DNA sequence may already be present in such a host. "Introduced," or "augmented" in this context, is known in the art to mean introduced or augmented by the hand of man. Thus, a recombinant gene can be a DNA sequence from another species or can be a DNA sequence that originated from or is present in the same species but has been incorporated into a host by recombinant methods to form a recombinant host. It will be appreciated that a recombinant gene that is introduced into a host can be identical to a DNA sequence that is normally present in the host being transformed, and is introduced to provide one or more additional copies of the DNA to thereby permit overexpression or modified expression of the gene product of that DNA. Said recombinant genes are particularly encoded by cDNA.

As used herein, the term "engineered biosynthetic pathway" refers to a biosynthetic pathway that occurs in a recombinant host, as described herein. In some aspects, one or more steps of the biosynthetic pathway do not naturally occur in an unmodified host. In some embodiments, a heterologous version of a gene is introduced into a host that comprises an endogenous version of the gene.

As used herein, the term "endogenous" gene refers to a gene that originates from and is produced or synthesized within a particular organism, tissue, or cell. In some embodiments, the endogenous gene is a yeast transporter. In some embodiments, the transporter is endogenous to S. cerevisiae, including, but not limited to S. cerevisiae strain S288C. In some embodiments, an endogenous yeast transporter gene is overexpressed. As used herein, the term "overexpress" is used to refer to the expression of a gene in an organism at levels higher than the level of gene expression in a wild type organism. See, e.g., Prelich, 2012, Genetics 190:841-54. In some embodiments, an endogenous yeast transporter gene is deleted. See, e.g., Giaever & Nislow, 2014, Genetics 197 (2):451-65. As used herein, the terms "deletion," "deleted," "knockout," and "knocked out" can be used interchangeably to refer to an endogenous gene that has been manipulated to no longer be expressed in an organism, including, but not limited to, S. cerevisiae. In some embodiments, a deleted/knocked out gene is a transporter gene or a transcription factor gene that regulates expression of a transporter gene.

As used herein, the terms "heterologous sequence" and "heterologous coding sequence" are used to describe a sequence derived from a species other than the recombinant host. In some embodiments, the recombinant host is an S. cerevisiae cell, and a heterologous sequence is derived from an organism other than S. cerevisiae. A heterologous coding sequence, for example, can be from a prokaryotic microorganism, a eukaryotic microorganism, a plant, an animal, an insect, or a fungus different than the recombinant host expressing the heterologous sequence. In some embodiments, a coding sequence is a sequence that is native to the host.

A "selectable marker" can be one of any number of genes that complement host cell auxotrophy, provide antibiotic resistance, or result in a color change. Linearized DNA fragments of the gene replacement vector then are introduced into the cells using methods well known in the art (see below). Integration of the linear fragments into the genome and the disruption of the gene can be determined based on the selection marker and can be verified by, for example, PCR or Southern blot analysis. Subsequent to its use in selection, a selectable marker can be removed from the genome of the host cell by, e.g., Cre-LoxP systems (see, e.g., Gossen et al., 2002, Ann. Rev. Genetics 36:153-173 and U.S. 2006/0014264). Alternatively, a gene replacement vector can be constructed in such a way as to include a portion of the gene to be disrupted, where the portion is devoid of any endogenous gene promoter sequence and encodes none, or an inactive fragment of, the coding sequence of the gene.

As used herein, the terms "variant" and "mutant" are used to describe a protein sequence that has been modified at one or more amino acids, compared to the wild type sequence of a particular protein.

As used herein, the term "inactive fragment" is a fragment of the gene that encodes a protein having, e.g., less than about 10% (e.g., less than about 9%, less than about 8%, less than about 7%, less than about 6%, less than about 5%, less than about 4%, less than about 3%, less than about 2%, less than about 1%, or 0%) of the activity of the protein produced from the full-length coding sequence of the gene. Such a portion of a gene is inserted in a vector in such a way that no known promoter sequence is operably linked to the gene sequence, but that a stop codon and a transcription termination sequence are operably linked to the portion of the gene sequence. This vector can be subsequently linearized in the portion of the gene sequence and transformed into a cell. By way of single homologous recombination, this linearized vector is then integrated in the endogenous counterpart of the gene with inactivation thereof.

As used herein, the term "steviol glycoside" refers to rebaudioside A (RebA) (CAS #58543-16-1), rebaudioside B (RebB) (CAS #58543-17-2), rebaudioside C (RebC) (CAS #63550-99-2), rebaudioside D (RebD) (CAS #63279-13-0), rebaudioside E (RebE) (CAS #63279-14-1), rebaudioside F (RebF) (CAS #438045-89-7), rebaudioside M (RebM) (CAS #1220616-44-3), rubusoside (CAS #63849-39-4), dulcoside A (CAS #64432-06-0), rebaudioside I (RebI) (MassBank Record: FU000332), rebaudioside Q (RebQ), 1,2-stevioside (CAS #57817-89-7), 1,3-stevioside (RebG), 1,2-bioside (MassBank Record: FU000299), 1,3-bioside, steviol-13-O-glucoside (13-SMG), steviol-19-O-glucoside (19-SMG), a tri-glucosylated steviol glycoside, a tetra-glycosylated steviol glycoside, a penta-glucosylated steviol glycoside, a hexa-glucosylated steviol glycoside, a hepta-glucosylated steviol glycoside, and isomers thereof. See FIG. 1.

As used herein, the terms "steviol glycoside precursor" and "steviol glycoside precursor compound" are used to refer to intermediate compounds in the steviol glycoside biosynthetic pathway. Steviol glycoside precursors include, but are not limited to, geranylgeranyl diphosphate (GGPP), ent-copalyl-diphosphate, ent-kaurene, ent-kaurenol, ent-kaurenal, ent-kaurenoic acid, and steviol. In some embodiments, steviol glycoside precursors are themselves steviol glycoside compounds. For example, 19-SMG, rubusoside, stevioside, and RebE are steviol glycoside precursors of RebM. See FIG. 1. Steviol glycosides and/or steviol glycoside precursors can be produced in vivo (i.e., in a recombinant host), in vitro (i.e., enzymatically), or by whole cell bioconversion. As used herein, the terms "produce" and "accumulate" can be used interchangeably to describe synthesis of steviol glycosides and steviol glycoside precursors in vivo, in vitro, or by whole cell bioconversion.

Recombinant steviol glycoside-producing *Saccharomyces cerevisiae* (*S. cerevisiae*) strains are described in WO 2011/153378, WO 2013/022989, WO 2014/122227, and WO 2014/122328, each of which has been incorporated by reference herein in its entirety. Methods of producing steviol glycosides in recombinant hosts, by whole cell bio-conversion, and in vitro are also described in WO 2011/153378, WO 2013/022989, WO 2014/122227, and WO 2014/122328.

In some embodiments, steviol glycosides and/or steviol glycoside precursors are produced in vivo through expression of one or more enzymes involved in the steviol glycoside biosynthetic pathway in a recombinant host. For example, a steviol-producing recombinant host expressing one or more of a gene encoding a geranylgeranyl diphosphate synthase (GGPPS) polypeptide, a gene encoding an ent-copalyl diphosphate synthase (CDPS) polypeptide, a gene encoding a kaurene synthase (KS) polypeptide, a gene encoding a kaurene oxidase polypeptide (KO), a gene encoding a steviol synthase (KAH) polypeptide, a gene encoding a cytochrome P450 reductase (CPR) polypeptide, and a gene encoding a UGT polypeptide can produce a steviol glycoside and/or steviol glycoside precursors in vivo. See Examples 1-4.

In another example, a recombinant host expressing a gene encoding a GGPPS polypeptide, a gene encoding a CDPS polypeptide, a gene encoding a KS polypeptide, a gene encoding a KO polypeptide, a gene encoding a KAH polypeptide, and a gene encoding a CPR polypeptide can produce steviol in vivo. The skilled worker will appreciate that one or more of these genes can be endogenous to the host provided that at least one (and in some embodiments, all) of these genes is a recombinant gene introduced into the recombinant host.

In another example, a recombinant host expressing a gene encoding a GGPPS polypeptide, a gene encoding a CDPS polypeptide, a gene encoding a KS polypeptide, a gene encoding a KO polypeptide, a gene encoding a KAH polypeptide, a gene encoding a CPR polypeptide, and one or more of a gene encoding a UGT polypeptide can produce a steviol glycoside in vivo. The skilled worker will appreciate that one or more of these genes can be endogenous to the host provided that at least one (and in some embodiments, all) of these genes is a recombinant gene introduced into the recombinant host.

In some aspects, the GGPPS polypeptide comprises a polypeptide having an amino acid sequence set forth in SEQ ID NO:208 (which can be encoded by the nucleotide sequence set forth in SEQ ID NO:207), SEQ ID NO:210 (encoded by the nucleotide sequence set forth in SEQ ID NO:209), SEQ ID NO:212 (encoded by the nucleotide sequence set forth in SEQ ID NO:211), SEQ ID NO:214 (encoded by the nucleotide sequence set forth in SEQ ID NO:213), SEQ ID NO:216 (encoded by the nucleotide sequence set forth in SEQ ID NO:215), SEQ ID NO:218 (encoded by the nucleotide sequence set forth in SEQ ID NO:217), SEQ ID NO:182 (encoded by the nucleotide sequence set forth in SEQ ID NO:181), or SEQ ID NO:220 (encoded by the nucleotide sequence set forth in SEQ ID NO:219).

In some aspects, the CDPS polypeptide comprises a polypeptide having an amino acid sequence set forth in SEQ ID NO:222 (which can be encoded by the nucleotide sequence set forth in SEQ ID NO:221), SEQ ID NO:224 (encoded by the nucleotide sequence set forth in SEQ ID NO:223), SEQ ID NO:226 (encoded by the nucleotide sequence set forth in SEQ ID NO:225), SEQ ID NO:228 (encoded by the nucleotide sequence set forth in SEQ ID NO:227), or SEQ ID NO:230 (encoded by the nucleotide sequence set forth in SEQ ID NO:229). In some embodiments, the CDPS polypeptide lacks a chloroplast transit peptide. For example, the CDPS polypeptide lacking a chloroplast transit polypeptide can comprise a polypeptide having an amino acid sequence set forth in SEQ D NO:184 (encoded by the nucleotide sequence set forth in SEQ ID NO:183).

In some aspects, the KS polypeptide comprises a polypeptide having an amino acid sequence set forth in SEQ ID NO:232 (which can be encoded by the nucleotide sequence set forth in SEQ ID NO:231), SEQ ID NO:234 (encoded by the nucleotide sequence set forth in SEQ ID NO:233), SEQ ID NO:236 (encoded by the nucleotide sequence set forth in SEQ ID NO:235), SEQ ID NO:238 (encoded by the nucleotide sequence set forth in SEQ ID NO:237), or SEQ ID NO:186 (encoded by the nucleotide sequence set forth in SEQ ID NO:185).

In some embodiments, a recombinant host comprises a gene encoding a CDPS-KS polypeptide. In some aspects, the CDPS-KS polypeptide comprises a polypeptide having an amino acid sequence set forth in SEQ ID NO:240 (which can be encoded by the nucleotide sequence set forth in SEQ ID NO:239), SEQ ID NO:242 (encoded by the nucleotide sequence set forth in SEQ ID NO:241), or SEQ ID NO:244 (encoded by the nucleotide sequence set forth in SEQ ID NO:243).

In some aspects, the KO polypeptide comprises a polypeptide having an amino acid sequence set forth in SEQ ID NO:188 (which can be encoded by the nucleotide sequence set forth in SEQ ID NO:187), SEQ ID NO:246 (encoded by the nucleotide sequence set forth in SEQ ID NO:245), SEQ ID NO:249 (encoded by the nucleotide sequence set forth in SEQ ID NO:247 or SEQ ID NO:248), SEQ ID NO:251 (encoded by the nucleotide sequence set forth in SEQ ID NO:250), SEQ ID NO:253 (encoded by the nucleotide sequence set forth in SEQ ID NO:252), SEQ ID NO:255 (encoded by the nucleotide sequence set forth in SEQ ID NO:254), SEQ ID NO:257 (encoded by the nucleotide sequence set forth in SEQ ID NO:256), SEQ ID NO:259 (encoded by the nucleotide sequence set forth in SEQ ID NO:258), or SEQ ID NO:261 (encoded by the nucleotide sequence set forth in SEQ ID NO:260).

In some aspects, the CPR polypeptide comprises a polypeptide having an amino acid sequence set forth in SEQ ID NO:263 (which can be encoded by the nucleotide sequence set forth in SEQ ID NO:262), SEQ ID NO:265 (encoded by the nucleotide sequence set forth in SEQ ID NO:264), SEQ ID NO:287 (encoded by the nucleotide sequence set forth in SEQ ID NO:286), SEQ ID NO:289 (encoded by the nucleotide sequence set forth in SEQ ID NO:288), SEQ ID NO:194 (encoded by the nucleotide sequence set forth in SEQ ID NO:193), SEQ ID NO:291 (encoded by the nucleotide sequence set forth in SEQ ID NO:290), SEQ ID NO:293 (encoded by the nucleotide sequence set forth in SEQ ID NO:292), or SEQ ID NO:190 (encoded by the nucleotide sequence set forth in SEQ ID NO:189).

In some aspects, the KAH polypeptide comprises a polypeptide having an amino acid sequence set forth in SEQ ID NO:192 (which can be encoded by the nucleotide sequence set forth in SEQ ID NO:191), SEQ ID NO:266 (encoded by the nucleotide sequence set forth in SEQ ID NO:294 or SEQ ID NO:295), SEQ ID NO:269 (encoded by the nucleotide sequence set forth in SEQ ID NO:267 or SEQ ID NO:268), SEQ ID NO:270, SEQ ID NO:271, SEQ ID NO:272, SEQ ID NO:273, SEQ ID NO:275 (encoded by the nucleotide sequence set forth in SEQ ID NO:274), SEQ ID NO:277 (encoded by the nucleotide sequence set forth in SEQ ID NO:276), SEQ ID NO:279 (encoded by the nucleotide sequence set forth in SEQ ID NO:278), SEQ ID NO:281 (encoded by the nucleotide sequence set forth in SEQ ID NO:280), or SEQ ID NO:283 (encoded by the nucleotide sequence set forth in SEQ ID NO:282).

In some embodiments, a recombinant host comprises a nucleic acid encoding a UGT85C2 polypeptide (SEQ ID NO:195, SEQ ID NO:196), a nucleic acid encoding a UGT76G1 polypeptide (SEQ ID NO:199, SEQ ID NO:200), a nucleic acid encoding a UGT74G1 polypeptide (SEQ ID NO:197, SEQ ID NO:198), a nucleic acid encoding a UGT91D2 polypeptide (i.e., UGT91D2e of SEQ ID NO:284, SEQ ID NO:285 or UGT91D2e-b of SEQ ID NO:201, SEQ ID NO:202), and/or a nucleic acid encoding a EUGT11 polypeptide (SEQ ID NO:203, SEQ ID NO:204). The skilled worker will appreciate that expression of these genes may be necessary to produce a particular steviol glycoside but that one or more of these genes can be endogenous to the host provided that at least one (and in some embodiments, all) of these genes is a recombinant gene introduced into the microorganism. In a particular embodiment, a steviol-producing recombinant microorganism comprises exogenous nucleic acids encoding UGT85C2, UGT76G1, or UGT91D2 polypeptides. In another particular embodiment, a steviol-producing recombinant microorganism comprises exogenous nucleic acids encoding UGT85C2, UGT76G1, UGT74G1, and UGT91D2 polypeptides. In yet another particular embodiment, a steviol-producing recombinant microorganism comprises exogenous nucleic acids encoding UGT85C2, UGT76G1, UGT74G1, and EUGT11 polypeptides. In yet another particular embodiment, a steviol-producing recombinant microorganism comprises the exogenous nucleic acids encoding UGT85C2, UGT76G1, UGT74G1, UGT91D2 (including inter alia 91D2e, 91D2m, 91D2e-b, and functional homologs thereof), and EUGT11 polypeptides. See Examples 1-4.

In certain embodiments, the steviol glycoside is RebA, RebB, RebD, and/or RebM. RebA can be synthesized in a steviol-producing recombinant microorganism expressing UGT85C2, UGT76G1, UGT74G1, and UGT91D2. RebB can be synthesized in a steviol-producing recombinant microorganism expressing UGT85C2, UGT76G1, and UGT91D2. RebD can be synthesized in a steviol-producing recombinant microorganism expressing UGT85C2, UGT76G1 UGT74G1, and UGT91D2 and/or EUGT11. RebM can be synthesized in a steviol-producing recombinant microorganism expressing UGT85C2, UGT76G1, UGT74G1, and UGT91D2 and/or EUGT11 (see FIG. 1).

In some embodiments, steviol glycosides and/or steviol glycoside precursors are produced through contact of a steviol glycoside precursor with one or more enzymes involved in the steviol glycoside pathway in vitro. For example, contacting steviol with a UGT polypeptide can result in production of a steviol glycoside in vitro. In some embodiments, a steviol glycoside precursor is produced through contact of an upstream steviol glycoside precursor with one or more enzymes involved in the steviol glycoside pathway in vitro. For example, contacting ent-kaurenoic acid with a KAH enzyme can result in production of steviol in vitro.

In some embodiments, a steviol glycoside or steviol glycoside precursor is produced by whole cell bioconversion. For whole cell bioconversion to occur, a host cell expressing one or more enzymes involved in the steviol glycoside pathway takes up and modifies a steviol glycoside precursor in the cell; following modification in vivo, a steviol glycoside remains in the cell and/or is excreted into the culture medium. For example, a host cell expressing a gene encoding a UGT polypeptide can take up steviol and glycosylate steviol in the cell; following glycosylation in vivo, a steviol glycoside can be excreted into the culture medium. In some embodiments, the cell is permeabilized to take up a substrate to be modified or to excrete a modified product.

In some embodiments, a steviol glycoside or steviol glycoside precursor composition produced in vivo, in vitro, or by whole cell bioconversion does not comprise or comprises a reduced amount of plant-derived components than a *stevia* extract from, inter alia, a *stevia* plant. Plant-derived components can contribute to off-flavors and include pigments, lipids, proteins, phenolics, saccharides, spathulenol and other sesquiterpenes, labdane diterpenes, monoterpenes, decanoic acid, 8,11,14-eicosatrienoic acid, 2-methyloctadecane, pentacosane, octacosane, tetracosane, octadecanol, stigmasterol, β-sitosterol, α- and β-amyrin, lupeol, β-amryin acetate, pentacyclic triterpenes, centauredin, quercitin, epi-alpha-cadinol, carophyllenes and derivatives, beta-pinene, beta-sitosterol, and gibberellin. In some embodiments, the plant-derived components referred to herein are non-glycoside compounds.

As used herein, the terms "detectable amount," "detectable concentration," "measurable amount," and "measurable concentration" refer to a level of steviol glycosides measured in AUC, $\mu M/OD_{600}$, mg/L, $\mu M$, or mM. Steviol glycoside production (i.e., total, supernatant, and/or intracellular steviol glycoside levels) can be detected and/or analyzed by techniques generally available to one skilled in the art, for example, but not limited to, liquid chromatography-mass spectrometry (LC-MS), thin layer chromatography (TLC), high-performance liquid chromatography (HPLC), ultraviolet-visible spectroscopy/spectrophotometry (UV-Vis), mass spectrometry (MS), and nuclear magnetic resonance spectroscopy (NMR).

As used herein, the term "undetectable concentration" refers to a level of a compound that is too low to be measured and/or analyzed by techniques such as TLC, HPLC, UV-Vis, MS, or NMR. In some embodiments, a compound of an "undetectable concentration" is not present in a steviol glycoside or steviol glycoside precursor composition.

As used herein, the terms "or" and "and/or" is utilized to describe multiple components in combination or exclusive of one another. For example, "x, y, and/or z" can refer to "x" alone, "y" alone, "z" alone, "x, y, and z," "(x and y) or z," "x or (y and z)," or "x or y or z." In some embodiments, "and/or" is used to refer to the exogenous nucleic acids that a recombinant cell comprises, wherein a recombinant cell comprises one or more exogenous nucleic acids selected from a group. In some embodiments, "and/or" is used to refer to production of steviol glycosides and/or steviol glycoside precursors. In some embodiments, "and/or" is used to refer to production of steviol glycosides, wherein one or more steviol glycosides are produced. In some embodiments, "and/or" is used to refer to production of steviol glycosides, wherein one or more steviol glycosides are produced through one or more of the following steps: culturing a recombinant microorganism, synthesizing one or more steviol glycosides in a recombinant microorganism, and/or isolating one or more steviol glycosides.

Functional Homologs

Functional homologs of the polypeptides described above are also suitable for use in producing steviol glycosides in a recombinant host. A functional homolog is a polypeptide that has sequence similarity to a reference polypeptide, and that carries out one or more of the biochemical or physiological function(s) of the reference polypeptide. A functional homolog and the reference polypeptide can be a natural occurring polypeptide, and the sequence similarity can be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, can themselves be functional homologs. Functional homologs can also be created via site-directed mutagenesis of the coding sequence for a polypeptide, or by combining domains from the coding sequences for different naturally-occurring polypeptides ("domain swapping"). Techniques for modifying genes encoding functional polypeptides described herein are known and include, inter alia, directed evolution techniques, site-directed mutagenesis techniques and random mutagenesis techniques, and can be useful to increase specific activity of a polypeptide, alter substrate specificity, alter expression levels, alter subcellular location, or modify polypeptide-polypeptide interactions in a desired manner. Such modified polypeptides are considered functional homologs. The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of steviol glycoside biosynthesis polypeptides. Sequence analysis can involve BLAST, Reciprocal BLAST, or PSI-BLAST analysis of non-redundant databases using a UGT amino acid sequence as the reference sequence. Amino acid sequence is, in some instances, deduced from the nucleotide sequence. Those polypeptides in the database that have greater than 40% sequence identity are candidates for further evaluation for suitability as a steviol glycoside biosynthesis polypeptide. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in steviol glycoside biosynthesis polypeptides, e.g., conserved functional domains. In some embodiments, nucleic acids and polypeptides are identified from transcriptome data based on expression levels rather than by using BLAST analysis.

Conserved regions can be identified by locating a region within the primary amino acid sequence of a steviol glycoside biosynthesis polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/and pfam.janelia.org/. The information included at the Pfam database is described in Sonnhammer et al., *Nucl. Acids Res.,* 26:320-322 (1998); Sonnhammer et al., Proteins, 28:405-420 (1997); and Bateman et al., *Nucl. Acids Res.,* 27:260-262 (1999). Conserved regions also can be determined by aligning sequences of the same or related polypeptides from closely related species. Closely related species preferably are from the same family. In some embodiments, alignment of sequences from two different species is adequate to identify such homologs.

Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

For example, polypeptides suitable for producing steviol in a recombinant host include functional homologs of UGTs.

Methods to modify the substrate specificity of, for example, a UGT, are known to those skilled in the art, and include without limitation site-directed/rational mutagenesis approaches, random directed evolution approaches and combinations in which random mutagenesis/saturation techniques are performed near the active site of the enzyme. For example see Osmani et al., 2009, *Phytochemistry* 70: 325-347.

A candidate sequence typically has a length that is from 80% to 250% of the length of the reference sequence, e.g., 82, 85, 87, 89, 90, 93, 95, 97, 99, 100, 105, 110, 115, 120, 130, 140, 150, 160, 170, 180, 190, 200, 210, 220, 230, 240, or 250% of the length of the reference sequence. A functional homolog polypeptide typically has a length that is from 95% to 105% of the length of the reference sequence, e.g., 90, 93, 95, 97, 99, 100, 105, 110, 115, or 120% of the length of the reference sequence, or any range between. A % identity for any candidate nucleic acid or polypeptide relative to a reference nucleic acid or polypeptide can be determined as follows. A reference sequence (e.g., a nucleic acid sequence or an amino acid sequence described herein) is aligned to one or more candidate sequences using the computer program Clustal Omega (version 1.2.1, default parameters), which allows alignments of nucleic acid or polypeptide sequences to be carried out across their entire length (global alignment). Chenna et al., 2003, *Nucleic Acids Res.* 31(13):3497-500.

Clustal Omega calculates the best match between a reference and one or more candidate sequences, and aligns them so that identities, similarities and differences can be determined. Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: % age; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: % age; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The Clustal Omega output is a sequence alignment that reflects the relationship between sequences. Clustal Omega can be run, for example, at the Baylor College of Medicine Search Launcher site on the World Wide Web (searchlauncher.bcm.tmc.edu/multi-align/multi-align.html) and at the European Bioinformatics Institute site at http://www.ebi.ac.uk/Tools/msa/clustalo/.

To determine a % identity of a candidate nucleic acid or amino acid sequence to a reference sequence, the sequences are aligned using Clustal Omega, the number of identical matches in the alignment is divided by the length of the reference sequence, and the result is multiplied by 100. It is noted that the % identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

It will be appreciated that functional UGT proteins can include additional amino acids that are not involved in the enzymatic activities carried out by the enzymes. In some embodiments, UGT proteins are fusion proteins. The terms "chimera," "fusion polypeptide," "fusion protein," "fusion enzyme," "fusion construct," "chimeric protein," "chimeric polypeptide," "chimeric construct," and "chimeric enzyme" can be used interchangeably herein to refer to proteins engineered through the joining of two or more genes that code for different proteins.

In some embodiments, a nucleic acid sequence encoding a UGT polypeptide can include a tag sequence that encodes a "tag" designed to facilitate subsequent manipulation (e.g., to facilitate purification or detection), solubility, secretion, or localization of the encoded polypeptide. Tag sequences can be inserted in the nucleic acid sequence encoding the polypeptide such that the encoded tag is located at either the carboxyl or amino terminus of the polypeptide. Non-limiting examples of encoded tags include green fluorescent protein (GFP), human influenza hemagglutinin (HA), glutathione S transferase (GST), polyhistidine-tag (HIS tag), disulfide oxiodoreductase (DsbA), maltose binding protein (MBP), N-utilization substance (NusA), small ubiquitin-like modifier (SUMO), and Flag™ tag (Kodak, New Haven, Conn.). Other examples of tags include a chloroplast transit peptide, a mitochondrial transit peptide, an amyloplast peptide, signal peptide, or a secretion tag.

In some embodiments, a fusion protein is a protein altered by domain swapping. As used herein, the term "domain swapping" is used to describe the process of replacing a domain of a first protein with a domain of a second protein. In some embodiments, the domain of the first protein and the domain of the second protein are functionally identical or functionally similar. In some embodiments, the structure and/or sequence of the domain of the second protein differs from the structure and/or sequence of the domain of the first protein. In some embodiments, a UGT polypeptide is altered by domain swapping.

Transporter Expression

This document describes reagents and methods that can be used to efficiently produce steviol glycoside compositions. Modification of transport systems in a recombinant host that are involved in transport of steviol glycosides into culture medium can allow for more effective production of steviol glycosides in recombinant hosts.

As set forth herein, recombinant cells having modifications to cellular transport are capable of producing steviol. Recombinant hosts described herein can produce steviol and have altered expression of at least one endogenous transporter gene. Recombinant hosts described herein can produce steviol and have altered expression of a transcription factor that regulates expression of at least one endogenous transporter gene. Altering expression of endogenous transporter genes can be useful for increasing production of steviol and/or excretion of steviol into the culture medium.

As set forth herein, recombinant cells having modifications to cellular transport are capable of producing at least one steviol glycoside, including, but not limited to, RebA, RebB, RebD, and/or RebM. Recombinant hosts described herein can produce at least one steviol glycoside such as RebA, RebB, RebD, and/or RebM and have altered expression of at least one endogenous transporter gene. Recombinant hosts described herein can produce at least one steviol glycoside such as RebA, RebB, RebD, and/or RebM and have altered expression of a trafficking adapter gene that regulates the stability of at least one endogenous transporter gene. Recombinant hosts described herein can produce at least one steviol glycoside such as RebA, RebB, RebD, and/or RebM and have altered expression of a plurality of endogenous transporter genes and/or of a plurality of trafficking adapter genes that regulate stability of a plurality of endogenous transporter genes. Altering expression of endogenous transporter genes and/or trafficking adapter genes can be useful for increasing production of steviol glycosides and/or excretion of steviol glycosides into the culture medium.

Recombinant hosts disclosed herein can include one or more biosynthesis genes, such as one or more genes encoding a sucrose transporter and a sucrose synthase; a gene encoding a geranylgeranyl diphosphate synthase (GGPPS) polypeptide; a gene encoding an ent-copalyl diphosphate synthase (CDPS) polypeptide; a gene encoding a kaurene synthase (KS) polypeptide; a gene encoding a kaurene oxidase (KO) polypeptide; a gene encoding a steviol synthase (KAH) polypeptide; a gene encoding a cytochrome P450 reductase (CPR) polypeptide; a gene encoding a UGT85C2 polypeptide; a gene encoding a UGT76G1 polypeptide; a gene encoding a UGT74G1 polypeptide; a gene encoding a UGT91D2 functional homolog; and/or a gene encoding a EUGT11 polypeptide; wherein expression of one or more of these genes results in production of steviol glycosides such as RebA, RebB, RebD, and/or RebM.

As used herein, the terms "transport of a steviol glycoside," "steviol glycoside transport," "excretion of a steviol glycoside," and "steviol glycoside excretion" can be used interchangeably.

As used herein, the term "transporter" (also referred to as a membrane transport protein) refers to a membrane protein involved in the movement of small molecules, macromolecules (such as carbohydrates), and ions across a biological membrane. Transporters span the membrane in which they are localized and across which they transport substances. Transporter proteins can assist in the movement (i.e., transport or excretion) of a substance from the intracellular space to the culture medium. Transporters are known to function as passive transport systems, carrying molecules down their concentration gradient, or as active transport systems, using energy to carry molecules uphill against their concentration gradient. Active transport is mediated by carriers which couple transport directly to the use of energy derived from hydrolysis of an ATP molecule or by carriers which make use of a pre-established electrochemical ion gradient to drive co-transport of the nutrient molecule and a co-transported ion. The latter category comprises symporters and antiporters, which carry the ion in the same or opposite direction, respectively, as the transported substrate.

Transport proteins have been classified according to various criteria at the Transporter Classification Database (on the world wide web at tcdb.org). See, Saier Jr. et al., Nucl. Acids Res., 42(1):D251-258 (2014). Non-limiting examples thereof include, among others, the family of Multiple Drug Resistance (MDR) plasma membrane transporters that is thought to be ubiquitous among living organisms. The MDR transporter superfamily can be further subdivided according to the mode of operation by which the substrate is transported from one side of the membrane to the other. Transporters can operate to move substances across membranes in response to chemiosmotic ion gradients or by active transport. ATP-binding cassette transporters (ABC transporters) are transmembrane proteins that utilize the energy of adenosine triphosphate (ATP) hydrolysis to carry out translocation of various substrates across membranes. They can transport a wide variety of substrates across the plasma membrane and intracellular membranes, including metabolic products, lipids and sterols, and drugs. Particular non-limiting examples of endogenous ABC transporter genes include PDR5, YDR061W, PDR15, SNQ2, YOR1, YOL075C, MDL2, ADP1, CAF16, VMR1 and STE6 (or a functional homolog thereof). In some aspects, ABC transporters transport steviol glycosides.

A second group of MDRs is further subdivided based on the nature of the chemiosmotic gradient that facilitates the transport. Saier, Jr. et al., J. Mol. Microbiol. Biotechnol. 1:257-279 (1999). In some aspects, MDR transporters transport steviol glycosides.

Another transporter family, the Major Facilitator Superfamily (MFS) transporters are monomeric polypeptides that can transport small solutes in response to proton gradients. The MFS transporter family is sometimes referred to as the uniporter-symporter-antiporter family. MFS transporters function in, inter alia, in sugar uptake and drug efflux systems. MFS transporters typically comprise conserved MFS-specific motifs. Non-limiting examples of endogenous MFS transporter genes include DTR1, SEO1, YBR241C, VBA3, FEN2, SNF3, STL1, HXT10, AZR1, MPH3, VBA5, GEX2, SNQ1, AQR1, MCH1, MCH5, ATG22, HXT15, MPH2, ITR1, SIT1, VPS73, HXT5, QDR1, QDR2, QDR3, SOA1, HXT9, YMR279C, YIL166C, HOL1, ENB1, TPO4 and FLR1 (or a functional homolog thereof). In some aspects, MFS transporters transport steviol glycosides. In some embodiments, PDR5, PDR15, SNQ2, or YOR1 transport kaurenoic acid, steviol, and/or steviol monosides.

Other transporter families include the SMR (small multidrug resistant) family, RND (Resistance-Nodulation-Cell Division) family, and the MATE (multidrug and toxic compound extrusion) family. The SMR family members are integral membrane proteins characterized by four alpha-helical transmembrane strands that confer resistance to a broad range of antiseptics, lipophilic quaternary ammonium compounds (QAC), and aminoglycoside resistance in bacteria. See, Bay & Turner, 2009, BMC Evol Biol., 9:140. In some aspects, SMR transporters transport steviol glycosides.

The MATE family members comprise 12 transmembrane (TM) domains. Members of the MATE family have been identified in prokaryotes, yeast such as S. cerevisiae and Schizosaccharomyces pombe, and plants. See Diener et al., 2001, Plant Cell. 13(7):1625-8. The MATE family members are sodium or proton antiporters. In some aspects, MATE transporters transport steviol glycosides.

Additional transporter families include the amino acid/auxin permease (AAAP) family (for example, YKL146W/AVT3, YBL089W/AVT5, YER119C/AVT6 and YIL088C/AVT7), ATPase family (for example, YBL099W/ATP1, YDL185W/VMA1, YLR447C/VMA6, YOL077W/ATP19, YPL078C/ATP4, YEL027W/VMA3, YKL016C/ATP7, and YOR332W/VMA4), sulfate permease (SulP) family (for example, YBR294W/SUL1, YGR125W and YPR003C), lysosomal cystine transporter (LCT) family (for example, YCR075C/ERS1), the Ca2+:cation antiporter (CaCA) family (for example, YDL128W/VCX1 and YJR106W/ECM27), the amino acid-polyamine-organocation (APC) superfamily (for example, YDL210W/UGA4, YOL020W/TAT2, YPL274W/SAM3, YNL268W/LYP1, YHL036W/MUP3, YKR039W/GAP1 and YOR348C/PUT4), multidrug/oligosaccharidyl-lipid/polysaccharide (MOP) (for example, YDR338C), ZRT/IRT-like protein (ZIP) metal transporter family (for example, YGL225W/ZRT1 and YOR079C/ATX2), the mitochondrial protein translocase (MPT) family (for example, YGR181W/TIM13, YNL070W/TOM7, YNL121C/TOM70, the voltage-gated ion channel (VIC) family (for example, YGR217W/CCH1 and YJL093C/TOK1), the monovalent cation:proton antiporter-2 (CPA2) family (for example, YJL094C/KHA1), the ThrE family of putative transmembrane amino acid efflux transporters (for example, YJL108C/PRM10), the oligopeptide transporter (OPT) family (for example, YJL212C/OPT1 and YGL114W), the K+ transporter (Trk) family (for example, TKR050W/TRK2), the bile acid:Na symporter (BASS) family (for example, YMR034C), the drug/metabolite transporter (DMT) superfamily (for example, YMR253C, YML038C/YMD8, and YOR307C/SLY41), the mitochondrial carrier (MC) family (for example, YMR056C/AAC1, YNL083W/SAL1, YOR130C/ORT1, YOR222W/ODC2, YPR011C, YPR058W/YMC1, YPR128C/ANT1, YEL006W/YEA6, YER053C/PIC2, YFR045W, YGR257C/MTM1, YHR002W/LEU5, YIL006W/YIA6, YJL133W/MRS3, YKL120W/OAC1, YMR166C, YNL003C/PET8 and YOR100C/CRC1), the auxin efflux carrier (AEC) family (for example, YNL095C, YOR092W/ECM3 and YBR287W), the ammonia channel transporter (Amt) family (for example, YNL142W/MEP2), the metal ion ($Mn^{2+}$-iron) transporter (Nramp) family (for example, YOL122C/SMF1), the transient receptor potential $Ca^{2+}$ channel (TRP-CC) family (for example, YOR087W/YVC1), the arsenical resistance-3 (ACR3) family (for example, YPR201W/ARR3), the nucleobase:cation symporter-1 (NCS1) family (for example, YBR021W/FUR4), the inorganic phosphate transporter (PiT) family (for example, YBR296C/PHO89), the arsenite-antimonite (ArsAB) efflux family (for example, YDL100C/GET3), the IISP family of transporters, the glycerol uptake (GUP) family (for example, YGL084C/GUP1), the metal ion transport (MIT) family (for example, YKL064W/MNR2, YKL050C and YOR334W/MRS2), the copper transport (Ctr) family (for example, YLR411W/CTR3) and the cation diffusion facilitator (CDF) family (for example, YOR316C/COT1). Particular members of any of these transporter families are included within the scope of the disclosed invention to the extent that altered expression in a cell capable of producing steviol glycoside increases production and/or excretion of said steviol glycoside.

Methods for identifying a gene affecting production or transport of steviol glycosides and steviol glycoside pathway intermediates are disclosed herein. Such methods can involve inactivating at least one endogenous transporter gene or modifying expression of at least one transporter gene. Typically, a library of mutant microorganisms is prepared, each mutant in the library having a different endogenous transporter gene inactivated. Methods of inactivating genes and determining their effect in a microorganims are known to a person having ordinary skill in the art; additional methods are disclosed in WO 2014/122328, the disclosure of which is incorporated by reference in its entirety. The mutant microorganisms comprising one or more steviol glycoside pathway genes are cultured in a medium under conditions in which steviol or a steviol glycoside is synthesized, and the amount of total, supernatant, and/or intracellular steviol glycosides produced by the microorganism is measured (e.g., using LC-MS) as described herein.

The disclosure is directed to recombinant host cells in which expression of an endogenous transporter gene or trafficking adapter gene is modified. In some embodiments, the transporter or trafficking adapter gene is endogenous to *S. cerevisiae*, including, but not limited to *S. cerevisiae* strain S288C. In some embodiments, expression of an endogenous transporter or trafficking adapter can be modified by replacing the endogenous promoter with a different promoter that results in increased expression of the transporter protein (e.g., at least a 5% increase in expression, such as at least a 10%, 15%, 20%, 25%, 30%, 35%, 40%, 45%, or 50%, 100%, 200% increase or more in expression). For example, an endogenous promoter can be replaced with a constitutive or inducible promoter that results in increased expression of the transporter. See, e.g., Partow et al., 2010, Yeast 27:955-64. Homologous recombination can be used to replace the promoter of an endogenous gene with a different promoter that results in increased expression of the transporter. In other embodiments, the inducible or constitutive promoter and endogenous transporter or trafficking adapter can be integrated into another locus of the genome using homologous recombination. In other embodiments, the transporter or trafficking adapter gene can be introduced into a microorganism using exogenous plasmids with a promoter that results in overexpression of the transporter or trafficking adapter in the microorganim. In yet another embodiment, the exogenous plasmids may also comprise multiple copies of the transporter or trafficking adapter gene. In a further embodiment, the endogenous transporter or trafficking adapter can be induced to be overexpressed using native mechanisms to the recombinant microorganism (e.g. heat shock, stress, heavy metal, or antibiotic exposure). In yet a further embodiment, the activity of an endogenous gene product is enhanced or increased (for example, by mutation). In yet another embodiment, a homologous or orthologous gene of an endogenous yeast transporter or trafficking adapter factor gene is overexpressed.

As used herein, the term "modified expression of a transporter gene" refers to a deletion of an endogenous gene encoding a transporter polypeptide, expression or overexpression of a gene encoding a Sugar Efflux Transporter (SET) transporter polypeptide, expression or overexpression of a gene encoding a SWEET transporter polypeptide, deletion or overexpression of a gene encoding a trafficking adapter polypeptide, expression or overexpression of an endogenous gene encoding a transporter polypeptide, or expression or overexpression of a heterologous gene encoding a transporter polypeptide.

In some embodiments, a steviol glycoside-producing host is transformed with a SET (sugar efflux transporter) or SWEET transporter. See, e.g., Chen et al., "Sugar transporters for intercellular exchange and nutrition of pathogens," Nature 468(7323):527-32 (2010) and Sun & Vanderpool, "Regulation and Function of *Escherichia coli* Sugar Efflux Transporter A (SetA) during Glucose-Phosphate Stress," Journal of Bacteriology 193(1):143-53 (2011). In some embodiments, the SET transporter is SetA from *E. coli* (SEQ ID NO:17, SEQ ID NO:18) (wherein the first SEQ ID NO sets forth the nucleic acid sequence of the gene and the second sets forth the deduced amino acid sequence of the encoded polypeptide), SetB from *E. coli* (SEQ ID NO:19, SEQ ID NO:20), or SetC from *E. coli* (SEQ ID NO:21, SEQ ID NO:22). In some embodiments, the SWEET transporter is SWEET from *Brassica rapa* (SEQ ID NO:23, SEQ ID NO:24), SWEET from *Petunia*xhybrid (SEQ ID NO:25, SEQ ID NO:26), or SWEET from *Triticum urartu* (SEQ ID NO:27, SEQ ID NO:28). In some embodiments, expression of a SET or SWEET transporter in a steviol glycoside-producing host results in improved excretion of a steviol glycoside such as RebA, RebB, RebD, or RebM. See Example 2.

In some embodiments, a transporter gene is knocked out of a steviol glycoside-producing host to decrease 13-SMG excretion. In some embodiments, the decrease in 13-SMG secretion results in an increase in production of steviol glycosides such as RebD and RebM. In some embodiments, the knocked out transporter gene is YOR087W (SEQ ID NO:1, SEQ ID NO:2), YML038C (SEQ ID NO:3, SEQ ID NO:4), YJR135W-A (SEQ ID NO:5, SEQ ID NO:6), YDR406W (SEQ ID NO:7, SEQ ID NO:8), YIR028W (SEQ ID NO:9, SEQ ID NO:10), YGR138C (SEQ ID NO:11, SEQ ID NO:12), YJL214W (SEQ ID NO:13, SEQ ID NO:14), or YDR345C (SEQ ID NO:15, SEQ ID NO:16). In some embodiments, deletion of one of YOR087W (SEQ ID NO:1, SEQ ID NO:2), YML038C (SEQ ID NO:3, SEQ ID NO:4), YJR135W-A (SEQ ID NO:5, SEQ ID NO:6), YDR406W (SEQ ID NO:7, SEQ ID NO:8), YIR028W (SEQ ID NO:9, SEQ ID NO:10), YGR138C (SEQ ID NO:11, SEQ ID NO:12), YJL214W (SEQ ID NO:13, SEQ ID NO:14), or YDR345C (SEQ ID NO:15, SEQ ID NO:16) results in a reduction of 13-SMG excretion by up to 70%. See Example 1.

In some embodiments, trafficking adapter proteins (also referred to herein as "adapter proteins") are knocked out of a steviol glycoside-producing host. Adapter proteins are involved in regulation of protein trafficking, protein translocation, gene expression, and endocytosis. See, e.g., Lin et al., 2008, Cell 135(4):714-25; Nikko & Pelham, 2009, Traffic 10(12):1856-67; and Nikko et al., 2008, EMBO Rep. 9(12):1216-21. In some aspects, deletion of a gene encoding an adapter protein results in stabilization of a transporter protein or prevents or slows degradation of a transporter protein. In some aspects, one or a plurality of genes encoding one or a plurality of adapter proteins are deleted. In some embodiments, the adapter protein is Art1 (SEQ ID NO:31, SEQ ID NO:32), Art2 (SEQ ID NO:34), Art3 (SEQ ID NO:35, SEQ ID NO:36), Art4 (SEQ ID NO:37, SEQ ID NO:38), Art6 (SEQ ID NO:39, SEQ ID NO:40), Art7 (SEQ ID NO:41, SEQ ID NO:42), Art8 (SEQ ID NO:43, SEQ ID NO:44), Art9 (SEQ ID NO:165, SEQ ID NO:166), Art10 (SEQ ID NO:29, SEQ ID NO:30), Bul1 (SEQ ID NO:45, SEQ ID NO:46), Bul2 (SEQ ID NO:47, SEQ ID NO:48), Tre1 (SEQ ID NO:173, SEQ ID NO:174), Ear1 (SEQ ID NO:169, SEQ ID NO:170), Ssh4 (SEQ ID NO:171, SEQ ID NO:172), or Bsd2 (SEQ ID NO:167, SEQ ID NO:168). See Example 3.

In some embodiments, deletion of Art1 (SEQ ID NO:31, SEQ ID NO:32), Art2 (SEQ ID NO:33, SEQ ID NO:34), Art3 (SEQ ID NO:35, SEQ ID NO:36), Art6 (SEQ ID NO:39, SEQ ID NO:40), Art7 (SEQ ID NO:41, SEQ ID NO:42), Art8 (SEQ ID NO:43, SEQ ID NO:44), Art9 (SEQ ID NO:165, SEQ ID NO:166), Art10 (SEQ ID NO:29, SEQ ID NO:30), Bul1 (SEQ ID NO:45, SEQ ID NO:46), Tre1 (SEQ ID NO:173, SEQ ID NO:174), Ear1 (SEQ ID NO:169, SEQ ID NO:170), Ssh4 (SEQ ID NO:171, SEQ ID NO:172), or Bsd2 (SEQ ID NO:167, SEQ ID NO:168) increases excretion of 13-SMG. See Example 3.

In some embodiments, deletion of Art1 (SEQ ID NO:31, SEQ ID NO:32), Art2 (SEQ ID NO:33, SEQ ID NO:34), Art3 (SEQ ID NO:35, SEQ ID NO:36), Art4 (SEQ ID NO:37, SEQ ID NO:38), Art6 (SEQ ID NO:39, SEQ ID NO:40), Art7 (SEQ ID NO:41, SEQ ID NO:42), Art8 (SEQ ID NO:43, SEQ ID NO:44), Art9 (SEQ ID NO:165, SEQ ID NO:166), Art10 (SEQ ID NO:29, SEQ ID NO:30), Bul1 (SEQ ID NO:45, SEQ ID NO:46), Bul2 (SEQ ID NO:47, SEQ ID NO:48), Tre1 (SEQ ID NO:173, SEQ ID NO:174), Ear1 (SEQ ID NO:169, SEQ ID NO:170), or Ssh4 (SEQ ID NO:171, SEQ ID NO:172) increases excretion of RebA. See Example 3.

In some embodiments, deletion of Art1 (SEQ ID NO:31, SEQ ID NO:32), Art2 (SEQ ID NO:33, SEQ ID NO:34), Art3 (SEQ ID NO:35, SEQ ID NO:36), Art4 (SEQ ID NO:37, SEQ ID NO:38), Art6 (SEQ ID NO:39, SEQ ID NO:40), Art7 (SEQ ID NO:41, SEQ ID NO:42), Art8 (SEQ ID NO:43, SEQ ID NO:44), Art9 (SEQ ID NO:165, SEQ ID NO:166), Art10 (SEQ ID NO:29, SEQ ID NO:30), Bul1 (SEQ ID NO:45, SEQ ID NO:46), Bul2 (SEQ ID NO:47, SEQ ID NO:48), Tre1 (SEQ ID NO:173, SEQ ID NO:174), Ear1 (SEQ ID NO:169, SEQ ID NO:170), Ssh4 (SEQ ID NO:171, SEQ ID NO:172), or Bsd2 (SEQ ID NO:167, SEQ ID NO:168) increases excretion of RebB. See Example 3.

In some embodiments, deletion of Art3 (SEQ ID NO:35, SEQ ID NO:36), Art7 (SEQ ID NO:41, SEQ ID NO:42), Art9 (SEQ ID NO:165, SEQ ID NO:166), Art10 (SEQ ID NO:29, SEQ ID NO:30), or Bul1 (SEQ ID NO:45, SEQ ID NO:46) increases excretion of RebD. See Example 3.

In some embodiments, deletion of Art1 (SEQ ID NO:31, SEQ ID NO:32), Art2 (SEQ ID NO:33, SEQ ID NO:34), Art3 (SEQ ID NO:35, SEQ ID NO:36), Art4 (SEQ ID NO:37, SEQ ID NO:38), Art6 (SEQ ID NO:39, SEQ ID NO:40), Art7 (SEQ ID NO:41, SEQ ID NO:42), Art8 (SEQ ID NO:43, SEQ ID NO:44), Art9 (SEQ ID NO:165, SEQ ID NO:166), Art10 (SEQ ID NO:29, SEQ ID NO:30), Bul1 (SEQ ID NO:45, SEQ ID NO:46), Bul2 (SEQ ID NO:47, SEQ ID NO:48), Tre1 (SEQ ID NO:173, SEQ ID NO:174), Ear1 (SEQ ID NO:169, SEQ ID NO:170), or Ssh4 (SEQ ID NO:171, SEQ ID NO:172) increases excretion of RebA. See Example 3.

In some embodiments, overexpression of Art1 (SEQ ID NO:31, SEQ ID NO:32), Art2 (SEQ ID NO:33, SEQ ID NO:34), Art3 (SEQ ID NO:35, SEQ ID NO:36), Art6 (SEQ ID NO:39, SEQ ID NO:40), Art7 (SEQ ID NO:41, SEQ ID NO:42), Art8 (SEQ ID NO:43, SEQ ID NO:44), Art9 (SEQ ID NO:165, SEQ ID NO:166), Art10 (SEQ ID NO:29, SEQ ID NO:30), Bul1 (SEQ ID NO:45, SEQ ID NO:46), Tre1 (SEQ ID NO:173, SEQ ID NO:174), Ear1 (SEQ ID NO:169, SEQ ID NO:170), Ssh4 (SEQ ID NO:171, SEQ ID NO:172), or Bsd2 (SEQ ID NO:167, SEQ ID NO:168) or deletion of Art4 (SEQ ID NO:37, SEQ ID NO:38) or Bul2 (SEQ ID NO:47, SEQ ID NO:48) decreases excretion of 13-SMG. In some embodiments, overexpression of Art1 (SEQ ID NO:31, SEQ ID NO:32), Art2 (SEQ ID NO:33, SEQ ID NO:34), Art3 (SEQ ID NO:35, SEQ ID NO:36), Art6 (SEQ ID NO:39, SEQ ID NO:40), Art7 (SEQ ID NO:41, SEQ ID NO:42), Art8 (SEQ ID NO:43, SEQ ID NO:44), Art9 (SEQ ID NO:165, SEQ ID NO:166), Art10 (SEQ ID NO:29, SEQ ID NO:30), Bul1 (SEQ ID NO:45, SEQ ID NO:46), Tre1 (SEQ ID NO:173, SEQ ID NO:174), Ear1 (SEQ ID NO:169, SEQ ID NO:170), Ssh4 (SEQ ID NO:171, SEQ ID NO:172), or Bsd2 (SEQ ID NO:167, SEQ ID NO:168) or deletion of Art4 (SEQ ID NO:37, SEQ ID NO:38) or Bul2 (SEQ ID NO:47, SEQ ID NO:48) increases production of RebA, RebB, RebD, and/or RebM.

In other embodiments, the adapter protein is Art5 (SEQ ID NO:163 SEQ ID NO:164) or Tre2 (SEQ ID NO:175, SEQ ID NO:176).

In some embodiments, deletion of a transporter gene in a steviol glycoside-producing host results in improved production of steviol glycosides. In some embodiments, the transporter deletion does not alter steviol glycoside excretion activity. In some embodiments, the deleted transporter gene that improves steviol glycoside production is YBR068C (SEQ ID NO:63, SEQ ID NO:64), YBR220C (SEQ ID NO:65, SEQ ID NO:66), YBR235W (SEQ ID NO:67, SEQ ID NO:68), YBR293W (SEQ ID NO:69, SEQ ID NO:70), YBR298C (SEQ ID NO:71, SEQ ID NO:72), YCR011C (SEQ ID NO:73, SEQ ID NO:74), YCR023C (SEQ ID NO:75, SEQ ID NO:76), YDL100C (SEQ ID NO:77, SEQ ID NO:78), YDL119C (SEQ ID NO:79, SEQ ID NO:80), YDL138W (SEQ ID NO:81, SEQ ID NO:82), YDL199C (SEQ ID NO:83, SEQ ID NO:84), YDL210W (SEQ ID NO:85, SEQ ID NO:86), YDL245C (SEQ ID NO:87, SEQ ID NO:88), YDR061W (SEQ ID NO:89, SEQ ID NO:90), YDR135C (SEQ ID NO:91, SEQ ID NO:92), YDR508C (SEQ ID NO:93, SEQ ID NO:94), YEL006W (SEQ ID NO:95, SEQ ID NO:96), YFL028C (SEQ ID NO:97, SEQ ID NO:98), YGL006W (SEQ ID NO:99, SEQ ID NO:100), YGL114W (SEQ ID NO:101, SEQ ID NO:102), YGR125W (SEQ ID NO:103, SEQ ID NO:104), YGR181W (SEQ ID NO:105, SEQ ID NO:106), YIL088C (SEQ ID NO:107, SEQ ID NO:108), YJR124C (SEQ ID NO:109, SEQ ID NO:110), YPL134C (SEQ ID NO:111, SEQ ID NO:112), YPR192W (SEQ ID NO:113, SEQ ID NO:114), YPR194C (SEQ ID NO:115, SEQ ID NO:116), YPR198W (SEQ ID NO:117, SEQ ID NO:118), YPR201W (SEQ ID NO:119, SEQ ID NO:120), YAL067C (SEQ ID NO:121, SEQ ID NO:122), YBL089W (SEQ ID NO:123, SEQ ID NO:124), YCR028C (SEQ ID NO:125, SEQ ID NO:126), YDR438W (SEQ ID NO:127, SEQ ID NO:128), YFL011W (SEQ ID NO:129, SEQ ID NO:130), YGL084C (SEQ ID NO:131, SEQ ID NO:132), YGL104C (SEQ ID NO:133, SEQ ID NO:134), YGR224W (SEQ ID NO:135, SEQ ID NO:136), YHR032W (SEQ ID NO:137, SEQ ID NO:138), YJL093C (SEQ ID NO:53, SEQ ID NO:54), YMR034C (SEQ ID NO:139, SEQ ID NO:140), YNR055C (SEQ ID NO:141, SEQ ID NO:142), YOL020W (SEQ ID NO:143, SEQ ID NO:144), or YOL075C (SEQ ID NO:145, SEQ ID NO:146). In some embodiments, RebA, RebB, RebD, and/or RebM production is increased. See Example 4.

Steviol and Steviol Glycoside Biosynthesis Nucleic Acids

A recombinant gene encoding a polypeptide described herein comprises the coding sequence for that polypeptide, operably linked in sense orientation to one or more regulatory regions suitable for expressing the polypeptide. Because many microorganisms are capable of expressing multiple gene products from a polycistronic mRNA, multiple polypeptides can be expressed under the control of a single regulatory region for those microorganisms, if desired. A coding sequence and a regulatory region are considered to be operably linked when the regulatory region and coding sequence are positioned so that the regulatory region is effective for regulating transcription or translation of the sequence. Typically, the translation initiation site of the translational reading frame of the coding sequence is positioned between one and about fifty nucleotides downstream of the regulatory region for a monocistronic gene.

In many cases, the coding sequence for a polypeptide described herein is identified in a species other than the recombinant host, i.e., is a heterologous nucleic acid. Thus, if the recombinant host is a microorganism, the coding sequence can be from other prokaryotic or eukaryotic microorganisms, from plants or from animals. In some case, however, the coding sequence is a sequence that is native to the host and is being reintroduced into that organism. A native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. "Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). A regulatory region is operably linked to a coding sequence by positioning the regulatory region and the coding sequence so that the regulatory region is effective for regulating transcription or translation of the sequence. For example, to operably link a coding sequence and a promoter sequence, the translation initiation site of the translational reading frame of the coding sequence is typically positioned between one and about fifty nucleotides downstream of the promoter. A regulatory region can, however, be positioned as much as about 5,000 nucleotides upstream of the translation initiation site, or about 2,000 nucleotides upstream of the transcription start site.

The choice of regulatory regions to be included depends upon several factors, including, but not limited to, efficiency, selectability, inducibility, desired expression level, and preferential expression during certain culture stages. It is a routine matter for one of skill in the art to modulate the expression of a coding sequence by appropriately selecting and positioning regulatory regions relative to the coding sequence. It will be understood that more than one regulatory region may be present, e.g., introns, enhancers, upstream activation regions, transcription terminators, and inducible elements.

One or more genes can be combined in a recombinant nucleic acid construct in "modules" useful for a discrete aspect of steviol and/or steviol glycoside production. Combining a plurality of genes in a module, particularly a polycistronic module, facilitates the use of the module in a variety of species. For example, a steviol biosynthesis gene cluster, or a UGT gene cluster, can be combined in a polycistronic module such that, after insertion of a suitable regulatory region, the module can be introduced into a wide variety of species. As another example, a UGT gene cluster can be combined such that each UGT coding sequence is operably linked to a separate regulatory region, to form a UGT module. Such a module can be used in those species for which monocistronic expression is necessary or desirable. In addition to genes useful for steviol or steviol glycoside production, a recombinant construct typically also contains an origin of replication, and one or more selectable markers for maintenance of the construct in appropriate species.

It will be appreciated that because of the degeneracy of the genetic code, a number of nucleic acids can encode a particular polypeptide; i.e., for many amino acids, there is more than one nucleotide triplet that serves as the codon for the amino acid. Thus, codons in the coding sequence for a given polypeptide can be modified such that optimal expression in a particular host is obtained, using appropriate codon bias tables for that host (e.g., microorganism). As isolated nucleic acids, these modified sequences can exist as purified molecules and can be incorporated into a vector or a virus for use in constructing modules for recombinant nucleic acid constructs.

In some cases, it is desirable to inhibit one or more functions of an endogenous polypeptide in order to divert metabolic intermediates towards steviol or steviol glycoside biosynthesis. For example, it may be desirable to downregulate synthesis of sterols in a yeast strain in order to further increase steviol or steviol glycoside production, e.g., by downregulating squalene epoxidase. As another example, it may be desirable to inhibit degradative functions of certain endogenous gene products, e.g., glycohydrolases that remove glucose moieties from secondary metabolites or phosphatases as discussed herein. As another example, expression of membrane transporters involved in transport of steviol glycosides can be activated, such that transportation of glycosylated steviosides is increased. Such regulation can be beneficial in that transportation of steviol glycosides can be increased for a desired period of time during culture of the microorganism, thereby increasing the yield of glycoside product(s) at harvest. In such cases, a nucleic acid that overexpresses the polypeptide or gene product may be included in a recombinant construct that is transformed into the strain. Alternatively, mutagenesis can be used to generate mutants in genes for which it is desired to increase or enhance function.

Host Microorganisms

Recombinant hosts can be used to express polypeptides for the producing steviol glycosides, including mammalian, insect, plant, and algal cells. A number of prokaryotes and eukaryotes are also suitable for use in constructing the recombinant microorganisms described herein, e.g., gram-negative bacteria, yeast, and fungi. A species and strain selected for use as a steviol glycoside production strain is first analyzed to determine which production genes are endogenous to the strain and which genes are not present. Genes for which an endogenous counterpart is not present in the strain are advantageously assembled in one or more recombinant constructs, which are then transformed into the strain in order to supply the missing function(s).

Typically, the recombinant microorganism is grown in a fermenter at a defined temperature(s) for a desired period of time. The constructed and genetically engineered microorganisms provided by the invention can be cultivated using conventional fermentation processes, including, inter alia, chemostat, batch, fed-batch cultivations, semi-continuous fermentations such as draw and fill, continuous perfusion fermentation, and continuous perfusion cell culture. Depending on the particular microorganism used in the method, other recombinant genes such as isopentenyl biosynthesis genes and terpene synthase and cyclase genes may also be present and expressed. Levels of substrates and intermediates, e.g., isopentenyl diphosphate, dimethylallyl diphosphate, GGPP, kaurene and kaurenoic acid, can be determined by extracting samples from culture media for analysis according to published methods.

Carbon sources of use in the instant method include any molecule that can be metabolized by the recombinant host cell to facilitate growth and/or production of the steviol glycosides. Examples of suitable carbon sources include, but are not limited to, sucrose (e.g., as found in molasses), fructose, xylose, ethanol, glycerol, glucose, cellulose, starch, cellobiose or other glucose-comprising polymer. In embodiments employing yeast as a host, for example, carbons sources such as sucrose, fructose, xylose, ethanol, glycerol, and glucose are suitable. The carbon source can be provided to the host organism throughout the cultivation period or alternatively, the organism can be grown for a period of time in the presence of another energy source, e.g., protein, and then provided with a source of carbon only during the fed-batch phase.

After the recombinant microorganism has been grown in culture for the desired period of time, steviol and/or one or more steviol glycosides can then be recovered from the culture using various techniques known in the art. In some embodiments, a permeabilizing agent can be added to aid the feedstock entering into the host and product getting out. For example, a crude lysate of the cultured microorganism can be centrifuged to obtain a supernatant. The resulting supernatant can then be applied to a chromatography column, e.g., a C-18 column, and washed with water to remove hydrophilic compounds, followed by elution of the compound(s) of interest with a solvent such as methanol. The compound(s) can then be further purified by preparative HPLC. See also, WO 2009/140394.

It will be appreciated that the various genes and modules discussed herein can be present in two or more recombinant hosts rather than a single host. When a plurality of recombinant hosts is used, they can be grown in a mixed culture to produce steviol and/or steviol glycosides.

Alternatively, the two or more hosts each can be grown in a separate culture medium and the product of the first culture medium, e.g., steviol, can be introduced into second culture medium to be converted into a subsequent intermediate, or into an end product such as, for example, RebA. The product produced by the second, or final host is then recovered. It will also be appreciated that in some embodiments, a recombinant host is grown using nutrient sources other than a culture medium and utilizing a system other than a fermenter.

Exemplary prokaryotic and eukaryotic species are described in more detail below. However, it will be appreciated that other species can be suitable. For example, suitable species can be in a genus such as *Agaricus, Aspergillus, Bacillus, Candida, Corynebacterium, Eremothecium, Escherichia, Fusarium/Gibberella, Kluyveromyces, Laetiporus, Lentinus, Phaffia, Phanerochaete, Pichia, Physcomitrella, Rhodoturula, Saccharomyces, Schizosaccharomyces, Sphaceloma, Xanthophyllomyces* or *Yarrowia*. Exemplary species from such genera include *Lentinus tigrinus, Laetiporus sulphureus, Phanerochaete chrysosporium, Pichia pastoris, Cyberlindnera jadinii, Physcomitrella patens, Rhodoturula glutinis, Rhodoturula mucilaginosa, Phaffia rhodozyma, Xanthophyllomyces dendrorhous, Fusarium fujikuroi/Gibberella fujikuroi, Candida utilis, Candida glabrata, Candida albicans*, and *Yarrowia lipolytica*.

In some embodiments, a microorganism can be a prokaryote such as *Escherichia coli*.

In some embodiments, a microorganism can be an Ascomycete such as *Gibberella fujikuroi, Kluyveromyces lactis, Schizosaccharomyces pombe, Aspergillus niger, Yarrowia lipolytica, Ashbya gossypii*, or *S. cerevisiae*.

In some embodiments, a microorganism can be an algal cell such as *Blakeslea trispora, Dunaliella salina, Haematococcus pluvialis, Chlorella* sp., *Undaria pinnatifida, Sargassum, Laminaria japonica, Scenedesmus almeriensis* species.

In some embodiments, a microorganism can be a cyanobacterial cell such as *Blakeslea trispora, Dunaliella salina, Haematococcus pluvialis, Chlorella* sp., *Undaria pinnatifida, Sargassum, Laminaria japonica, Scenedesmus almeriensis*.

*Saccharomyces* spp.

*Saccharomyces* is a widely used chassis organism in synthetic biology, and can be used as the recombinant microorganism platform. For example, there are libraries of mutants, plasmids, detailed computer models of metabolism and other information available for *S. cerevisiae*, allowing for rational design of various modules to enhance product yield. Methods are known for making recombinant microorganisms.

*Aspergillus* spp.

*Aspergillus* species such as *A. oryzae, A. niger* and *A. sojae* are widely used microorganisms in food production and can also be used as the recombinant microorganism platform. Nucleotide sequences are available for genomes of *A. nidulans, A. fumigatus, A. oryzae, A. clavatus, A. flavus, A. niger*, and *A. terreus*, allowing rational design and modification of endogenous pathways to enhance flux and increase product yield. Metabolic models have been developed for *Aspergillus*, as well as transcriptomic studies and proteomics studies. *A. niger* is cultured for the industrial production of a number of food ingredients such as citric acid and gluconic acid, and thus species such as *A. niger* are generally suitable for producing steviol glycosides.

E. coli

*E. coli*, another widely used platform organism in synthetic biology, can also be used as the recombinant microorganism platform. Similar to *Saccharomyces*, there are libraries of mutants, plasmids, detailed computer models of metabolism and other information available for *E. coli*, allowing for rational design of various modules to enhance product yield. Methods similar to those described above for *Saccharomyces* can be used to make recombinant *E. coli* microorganisms.

*Agaricus*, *Gibberella*, and *Phanerochaete* spp.

*Agaricus*, *Gibberella*, and *Phanerochaete* spp. can be useful because they are known to produce large amounts of isoprenoids in culture. Thus, the terpene precursors for producing large amounts of steviol glycosides are already produced by endogenous genes. Thus, modules comprising recombinant genes for steviol glycoside biosynthesis polypeptides can be introduced into species from such genera without the necessity of introducing mevalonate or MEP pathway genes.

*Arxula adeninivorans* (*Blastobotrys adeninivorans*)

*Arxula adeninivorans* is dimorphic yeast (it grows as budding yeast like the baker's yeast up to a temperature of 42° C., above this threshold it grows in a filamentous form) with unusual biochemical characteristics. It can grow on a wide range of substrates and can assimilate nitrate. It has successfully been applied to the generation of strains that can produce natural plastics or the development of a biosensor for estrogens in environmental samples.

*Yarrowia lipolytica*

*Yarrowia lipolytica* is dimorphic yeast (see *Arxula adeninivorans*) and belongs to the family Hemiascomycetes. The entire genome of *Yarrowia lipolytica* is known. *Yarrowia* species is aerobic and considered to be non-pathogenic. *Yarrowia* is efficient in using hydrophobic substrates (e.g. alkanes, fatty acids, oils) and can grow on sugars. It has a high potential for industrial applications and is an oleaginous microorgamism. *Yarrowia lipolyptica* can accumulate lipid content to approximately 40% of its dry cell weight and is a model organism for lipid accumulation and remobilization. See e.g., Nicaud, 2012, *Yeast* 29(10):409-18; Beopoulos et al., 2009, *Biochimie* 91(6):692-6; Bankar et al., 2009, *Appl Microbiol Biotechnol.* 84(5):847-65.

*Rhodotorula* sp.

*Rhodotorula* is unicellular, pigmented yeast. The oleaginous red yeast, *Rhodotorula glutinis*, has been shown to produce lipids and carotenoids from crude glycerol (Saenge et al., 2011, *Process Biochemistry* 46(1):210-8). *Rhodotorula toruloides* strains have been shown to be an efficient fed-batch fermentation system for improved biomass and lipid productivity (Li et al., 2007, *Enzyme and Microbial Technology* 41:312-7).

*Rhodosporidium toruloides*

*Rhodosporidium toruloides* is oleaginous yeast and useful for engineering lipid-production pathways (See e.g. Zhu et al., 2013, *Nature Commun.* 3:1112; Ageitos et al., 2011, *Applied Microbiology and Biotechnology* 90(4): 1219-27).

*Candida boidinii*

*Candida boidinii* is methylotrophic yeast (it can grow on methanol). Like other methylotrophic species such as *Hansenula polymorpha* and *Pichia pastoris*, it provides an excellent platform for producing heterologous proteins. Yields in a multigram range of a secreted foreign protein have been reported. A computational method, IPRO, recently predicted mutations that experimentally switched the cofactor specificity of *Candida boidinii* xylose reductase from NADPH to NADH. See, e.g., Mattanovich et al., 2012, *Methods Mol Biol.* 824:329-58; Khoury et al., 2009, *Protein Sci.* 18(10):2125-38.

*Hansenula polymorpha* (*Pichia angusta*)

*Hansenula polymorpha* is methylotrophic yeast (see *Candida boidinii*). It can furthermore grow on a wide range of other substrates; it is thermo-tolerant and can assimilate nitrate (see also *Kluyveromyces lactis*). It has been applied to producing hepatitis B vaccines, insulin and interferon alpha-2a for the treatment of hepatitis C, furthermore to a range of technical enzymes. See, e.g., Xu et al., 2014, *Virol Sin.* 29(6):403-9.

*Kluyveromyces lactis*

*Kluyveromyces lactis* is yeast regularly applied to the production of kefir. It can grow on several sugars, most importantly on lactose which is present in milk and whey. It has successfully been applied among others for producing chymosin (an enzyme that is usually present in the stomach of calves) for producing cheese. Production takes place in fermenters on a 40,000 L scale. See, e.g., van Ooyen et al., 2006, *FEMS Yeast Res.* 6(3):381-92.

*Pichia pastoris*

*Pichia pastoris* is methylotrophic yeast (see *Candida boidinii* and *Hansenula polymorpha*). It provides an efficient platform for producing foreign proteins. Platform elements are available as a kit and it is worldwide used in academia for producing proteins. Strains have been engineered that can produce complex human N-glycan (yeast glycans are similar but not identical to those found in humans). See, e.g., Piirainen et al., 2014, *N Biotechnol.* 31(6):532-7.

*Physcomitrella* spp.

*Physcomitrella* mosses, when grown in suspension culture, have characteristics similar to yeast or other fungal cultures. This genera can be used for producing plant secondary metabolites, which can be difficult to produce in other types of cells.

Steviol Glycoside Compositions

Steviol glycosides do not necessarily have equivalent performance in different food systems. It is therefore desirable to have the ability to direct the synthesis to steviol glycoside compositions of choice. Recombinant hosts described herein can produce compositions that are selectively enriched for specific steviol glycosides (e.g., RebD or RebM) and have a consistent taste profile. Thus, the recombinant hosts described herein can facilitate the production of compositions that are tailored to meet the sweetening profile desired for a given food product and that have a proportion of each steviol glycoside that is consistent from batch to batch. Hosts described herein do not produce the undesired plant by-products found in *Stevia* extracts. Thus, steviol glycoside compositions produced by the recombinant hosts described herein are distinguishable from compositions derived from *Stevia* plants.

The amount of an individual steviol glycoside (e.g., RebA, RebB, RebD, or RebM) produced can be from about 1 mg/L to about 7,000 mg/L, e.g., about 1 to about 10 mg/L, about 3 to about 10 mg/L, about 5 to about 20 mg/L, about 10 to about 50 mg/L, about 10 to about 100 mg/L, about 25 to about 500 mg/L, about 100 to about 1,500 mg/L, or about 200 to about 1,000 mg/L, at least about 1,000 mg/L, at least about 1,200 mg/L, at least about at least 1,400 mg/L, at least about 1,600 mg/L, at least about 1,800 mg/L, at least about 2,800 mg/L, or at least about 7,000 mg/L. In some aspects, the amount of an individual steviol glycoside can exceed 7,000 mg/L. The amount of a combination of steviol glycosides (e.g., RebA, RebB, RebD, or RebM) produced can be from about 1 mg/L to about 7,000 mg/L, e.g., about 200 to about 1,500, at least about 2,000 mg/L, at least about 3,000 mg/L, at least about 4,000 mg/L, at least about 5,000 mg/L, at least about 6,000 mg/L, or at least about 7,000 mg/L. In some aspects, the amount of a combination of steviol glycosides can exceed 7,000 mg/L. In general, longer culture times will lead to greater amounts of product. Thus, the recombinant microorganism can be cultured for from 1 day to 7 days, from 1 day to 5 days, from 3 days to 5 days, about 3 days, about 4 days, or about 5 days.

It will be appreciated that the various genes and modules discussed herein can be present in two or more recombinant microorganisms rather than a single microorganism. When a plurality of recombinant microorganisms is used, they can be grown in a mixed culture to produce steviol and/or steviol glycosides. For example, a first microorganism can comprise one or more biosynthesis genes for producing steviol and null mutations in a first group of endogenous transporters, while a second microorganism comprises steviol glycoside biosynthesis genes and null mutations in a second group of endogenous transporters. The product produced by the second, or final microorganism is then recovered. It will also be appreciated that in some embodiments, a recombinant microorganism is grown using nutrient sources other than a culture medium and utilizing a system other than a fermenter.

Alternatively, the two or more microorganisms each can be grown in a separate culture medium and the product of the first culture medium, e.g., steviol, can be introduced into second culture medium to be converted into a subsequent intermediate, or into an end product such as RebA. The product produced by the second, or final microorganism is then recovered. The microorganisms can have the same or a different group of mutations in endogenous transporters. It will also be appreciated that in some embodiments, a recombinant microorganism is grown using nutrient sources other than a culture medium and utilizing a system other than a fermenter.

Steviol glycosides do not necessarily have equivalent performance in different food systems. It is therefore desirable to have the ability to direct the synthesis to steviol glycoside compositions of choice. Recombinant hosts described herein can produce compositions that are selectively enriched for specific steviol glycosides (e.g., RebD) and have a consistent taste profile. Thus, the recombinant microorganisms described herein can facilitate the production of compositions that are tailored to meet the sweetening profile desired for a given food product and that have a proportion of each steviol glycoside that is consistent from batch to batch. Microorganisms described herein do not produce the undesired plant byproducts found in *Stevia* extracts. Thus, steviol glycoside compositions produced by the recombinant microorganisms described herein are distinguishable from compositions derived from *Stevia* plants.

Steviol glycosides and compositions obtained by the methods disclosed herein can be used to make food products, dietary supplements and sweetener compositions. See, e.g., WO 2011/153378, WO 2013/022989, WO 2014/122227, and WO 2014/122328, each of which has been incorporated by reference in its entirety.

For example, substantially pure steviol or steviol glycoside such as RebM or RebD can be included in food products such as ice cream, carbonated beverages, fruit juices, yogurts, baked goods, chewing gums, hard and soft candies, and sauces. Substantially pure steviol or steviol glycoside can also be included in non-food products such as pharmaceutical products, medicinal products, dietary supplements and nutritional supplements. Substantially pure steviol or steviol glycosides may also be included in animal feed products for both the agriculture industry and the companion animal industry. Alternatively, a mixture of steviol and/or steviol glycosides can be made by culturing recombinant microorganisms separately, each producing a specific steviol or steviol glycoside, recovering the steviol or steviol glycoside in substantially pure form from each microorganism and then combining the compounds to obtain a mixture comprising each compound in the desired proportion. The recombinant microorganisms described herein permit more precise and consistent mixtures to be obtained compared to current *Stevia* products. For example, recombinant microorganisms described herein can express transporters specific for transport of a particular steviol glycoside into the culture medium. When a transporter is specific for a particular steviol glycoside it will enrich the concentration of that compound in the fermentation broth, preventing it from being further reacted to a different compound, and by selectively transporting the steviol glycoside into the fermentation broth it will make it easier to recover from the other steviol glycosides and therefore making the process more efficient.

In another alternative, a substantially pure steviol or steviol glycoside can be incorporated into a food product along with other sweeteners, e.g. saccharin, dextrose, sucrose, fructose, erythritol, aspartame, sucralose, monatin, or acesulfame potassium. The weight ratio of steviol or steviol glycoside relative to other sweeteners can be varied as desired to achieve a satisfactory taste in the final food product. See, e.g., U.S. 2007/0128311. In some embodiments, the steviol or steviol glycoside may be provided with a flavor (e.g., citrus) as a flavor modulator.

Compositions produced by a recombinant microorganism described herein can be incorporated into food products. For example, a steviol glycoside composition produced by a recombinant microorganism can be incorporated into a food product in an amount ranging from about 20 mg steviol glycoside/kg food product to about 1800 mg steviol glycoside/kg food product on a dry weight basis, depending on the type of steviol glycoside and food product. For example, a steviol glycoside composition produced by a recombinant microorganism can be incorporated into a dessert, cold confectionary (e.g., ice cream), dairy product (e.g., yogurt), or beverage (e.g., a carbonated beverage) such that the food product has a maximum of 500 mg steviol glycoside/kg food on a dry weight basis. A steviol glycoside composition produced by a recombinant microorganism can be incorporated into a baked good (e.g., a biscuit) such that the food product has a maximum of 300 mg steviol glycoside/kg food on a dry weight basis. A steviol glycoside composition produced by a recombinant microorganism can be incorporated into a sauce (e.g., chocolate syrup) or vegetable product (e.g., pickles) such that the food product has a maximum of 1000 mg steviol glycoside/kg food on a dry weight basis. A steviol glycoside composition produced by a recombinant microorganism can be incorporated into a bread such that the food product has a maximum of 160 mg steviol glycoside/kg food on a dry weight basis. A steviol glycoside composition produced by a recombinant microorganism, plant, or plant cell can be incorporated into a hard or soft candy such that the food product has a maximum of 1600 mg steviol glycoside/kg food on a dry weight basis. A steviol glycoside composition produced by a recombinant microorganism, plant, or plant cell can be incorporated into a processed fruit product (e.g., fruit juices, fruit filling, jams, and jellies) such that the food product has a maximum of 1000 mg steviol glycoside/kg food on a dry weight basis.

For example, such a steviol glycoside composition can have from 90-99% RebA and an undetectable amount of *stevia* plant-derived components, and be incorporated into a food product at from 25-1600 mg/kg, e.g., 100-500 mg/kg, 25-100 mg/kg, 250-1000 mg/kg, 50-500 mg/kg or 500-1000 mg/kg on a dry weight basis.

Such a steviol glycoside composition can be a RebB-enriched composition having greater than 3% RebB and be incorporated into the food product such that the amount of RebB in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebB-enriched composition has an undetectable amount of *stevia* plant-derived components.

Such a steviol glycoside composition can be a RebD-enriched composition having greater than 3% RebD and be incorporated into the food product such that the amount of RebD in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebD-enriched composition has an undetectable amount of *stevia* plant-derived components.

Such a steviol glycoside composition can be a RebE-enriched composition having greater than 3% RebE and be incorporated into the food product such that the amount of RebE in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebE-enriched composition has an undetectable amount of *stevia* plant-derived components.

Such a steviol glycoside composition can be a RebM-enriched composition having greater than 3% RebM and be incorporated into the food product such that the amount of RebM in the product is from 25-1600 mg/kg, e.g., 100-500 mg/kg, 25-100 mg/kg, 250-1000 mg/kg, 50-500 mg/kg or 500-1000 mg/kg on a dry weight basis. Typically, the RebM-enriched composition has an undetectable amount of *stevia* plant-derived components.

In some embodiments, a substantially pure steviol or steviol glycoside is incorporated into a tabletop sweetener or "cup-for-cup" product. Such products typically are diluted to the appropriate sweetness level with one or more bulking agents, e.g., maltodextrins, known to those skilled in the art. Steviol glycoside compositions enriched for RebA, RebB, RebD, RebE, or RebM, can be package in a sachet, for example, at from 10,000 to 30,000 mg steviol glycoside/kg product on a dry weight basis, for tabletop use.

The invention will be further described in the following examples, which do not limit the scope of the invention described in the claims.

EXAMPLES

The Examples that follow are illustrative of specific embodiments of the invention, and various uses thereof. They are set forth for explanatory purposes only, and are not to be taken as limiting the invention.

Example 1. Identification of 13-SMG Transporter Candidates

Mechanisms of 13-SMG excretion from a RebD/RebM-producing strain were determined by analyzing 13-SMG levels in both the supernatant and in a complete (total) extract of transporter knockout *S. cerevisiae* strains. A RebD/RebM-producing strain comprised a recombinant gene encoding a *Synechococcus* sp. GGPPS7 polypeptide (SEQ ID NO:181, SEQ ID NO:182), a recombinant gene encoding a truncated *Zea mays* CDPS polypeptide (SEQ ID NO:183, SEQ ID NO:184), a recombinant gene encoding an *A. thaliana* KS5 polypeptide (SEQ ID NO:185, SEQ ID NO:186), a recombinant gene encoding a recombinant *S. rebaudiana* KO1 polypeptide (SEQ ID NO:187, SEQ ID NO:188), a recombinant gene encoding an *A. thaliana* ATR2 polypeptide (SEQ ID NO:189, SEQ ID NO:190), a recombinant gene encoding an SrKAHe1 polypeptide (SEQ ID NO:191, SEQ ID NO:192), a recombinant gene encoding an *S. rebaudiana* CPR8 polypeptide (SEQ ID NO:193, SEQ ID NO:194), a recombinant gene encoding an *S. rebaudiana* UGT85C2 polypeptide (SEQ ID NO:195, SEQ ID NO:196), a recombinant gene encoding an *S. rebaudiana* UGT74G1 polypeptide (SEQ ID NO:197, SEQ ID NO:198), a recombinant gene encoding an *S. rebaudiana* UGT76G1 polypeptide (SEQ ID NO:199, SEQ ID NO:200), a recombinant gene encoding an *S. rebaudiana* UGT91D2e-b polypeptide (SEQ ID NO:201, SEQ ID NO:202), and a recombinant gene encoding an *O. sativa* EUGT11 (SEQ ID NO:203, SEQ ID NO:204) polypeptide was used.

Transporter RNA levels of the RebD/M-producing strain were measured throughout a fermentation cycle by RNA-seq (Illumina HiSeq) and normalized to RNA levels of a control stain, which did not produce steviol glycosides, measured under similar conditions to identify 13-SMG transporter candidates based on the expression profiles of transporter genes. See, e.g., Wang et al., 2010, Nat Rev Genet. 19(1): 57-63; Nagalakshmi et al., 2008, Science 320(5881):1344-9; Garber et al., 2011, Nat Methods 8(6):469-77; and Robinson & Oshlack et al., 2010, Genome Biol. 11(3):R25, each of which is incorporated by reference herein in its entirety. RNA preparation was performed as described in Wilhelm et al., 2010, Nature Protocols 5:255-66, which is incorporated by reference herein in its entirety.

Transporter genes were individually knocked out in the RebD/M-producing strain based upon the RNA-seq results described below, and total and supernatant levels of 13-SMG were measured by LC-MS in each transporter knockout strain and a RebD/M-producing background strain, which did not have any transporter genes deleted. Relative excretion was calculated as the 13-SMG supernatant/total ratio of each transporter knockout strain divided by the 13-SMG supernatant/total ratio of the RebD/M-producing control strain. A relative excretion value of less than 1 corresponds to a decrease in 13-SMG excretion by a transporter knockout strain, compared to 13-SMG excretion by a RebD/M-producing control strain (i.e., less than 100% 13-SMG excretion of the control strain). A relative excretion value of 1 corresponds to 13-SMG excretion by a transporter knockout strain equal to that by a RebD/M-producing control strain (i.e., 100% 13-SMG excretion of the control strain). A relative excretion value of greater than 1 corresponds to an increase in 13-SMG excretion by a transporter knockout strain, compared to 13-SMG excretion by a RebD/M-producing control strain (i.e., greater than 100% 13-SMG excretion of the control strain).

LC-MS analyses were performed using an Ultimate 3000 UPLC system (Dionex) fitted with a waters acquity UPLC® BEH shield RP18 column (2.1×50 mm, 1.7 µm particles, 130 Å pore size) connected to a TSQ Quantum Access (ThermoFisher Scientific) triple quadrupole mass spectrometer with a heated electrospray ion (HESI) source, unless otherwise indicated. Elution was carried out using a mobile phase of eluent B (MeCN with 0.1% Formic acid) and eluent A (water with 0.1% Formic acid) by increasing the gradient from 25% to 47% B from 0.0 to 4.0 min, increasing 47% to 100% B from 4.0 to 5.0 min, holding 100% B from 5.0 to 6.5 min re-equilibration. The flow rate was 0.4 mL/min, and the column temperature 35° C. The steviol glycosides were detected using SIM (Single Ion Monitoring) with m/z-traces shown in Table 1. The levels of steviol glycosides were quantified by comparing with calibration curves obtained with authentic standards from LGC Standards.

TABLE 1

LC-MS analytical information for Steviol Glycosides.

| Description | Exact Mass | m/z trace | compound (typical $t_R$ in min) |
|---|---|---|---|
| Steviol + 1 Glucose | $[M + H]^+$ 481.2796 $[M + Na]^+$ 503.2615 | 481.2 ± 0.5 503.1 ± 0.5 | 19-SMG (2.29), 13-SMG (3.5) |
| Steviol + 2 Glucose | $[M + Na]^+$ 665.3149 | 665 ± 0.5 | rubusoside (2.52) Steviol-1,2-bioside (2.92) Steviol-1,3-bioside (2.28) |
| Steviol + 3 Glucose | $[M + Na]^+$ 827.3677 | 827.4 ± 0.5 | 1,2-stevioside (2.01) 1,3-stevioside (2.39) RebB (2.88) |
| Steviol + 4 Glucose | $[M + Na]^+$ 989.4200 | 989.4 ± 0.5 | RebA (2.0) |
| Steviol + 5 Glucose | $[M + Na]^+$ 1151.4728 | 1151.4 ± 0.5 | RebD (1.1) |
| Steviol + 6 Glucose | $[M + Na]^+$ 1313.5257 | 1313.5 ± 0.5 | RebM (1.3) |

Specificity for 13-SMG, as described herein, was assessed according to measured 13-SMG supernatant/total level ratios and efficacy of overexpression. To classify potential 13-SMG transporter candidates, calculated relative 13-SMG supernatant/total ratios were plotted against relative expression levels for each transporter. Three classes of transporters were identified. The first class of transporters (YOR087W, YML038C, YJR135W-A, YDR406W) demonstrated a higher specificity for 13-SMG compared to a steviol glycoside-producing control strain, but the transporters of the first class were not overexpressed compared to a control strain that did not produce steviol glycosides. The second class of transporters (YIR028W, YGR138C, YJL214W, and YDR345C) demonstrated low 13-SMG specificity compared to a steviol glycoside-producing control strain but high expression levels compared to a control strain that did not produce steviol glycosides. The third class of transporters tested demonstrated a low 13-SMG specificity compared to a steviol glycoside-producing control strain and were not overexpressed compared to a control strain that did not produce steviol glycosides. The transporters of the first and second classes were believed to be capable of excreting more 13-SMG than the transporters of the third class.

Table 2 shows expression levels and relative 13-SMG excretion of YOR087W, YML038C, YJR135W-A, YDR406W, YIR028W, YGR138C, YJL214W, and YDR345C. For example, at the 19 h time point of fermentation, the expression level of YOR087W (SEQ ID NO:1, SEQ ID NO:2) in a RebD/M-producing strain is 86.93% that of the expression level of YOR087W in a control strain. Upon deletion of YOR087W in a RebD/M-producing strain, the 13-SMG supernatant/total ratio was 31% that of the 13-SMG supernatant/total ratio of a RebD/M-producing control strain. In another example, at the 19 h time point of fermentation, the expression level of YDR345C (SEQ ID NO:15, SEQ ID NO:16) was 1,512.89% of the expression level of YDR345C in a control strain. Upon deletion of YDR345C in a RebD/M-producing strain, the 13-SMG supernatant/total ratio was 75.10% that of the 13-SMG supernatant/total ratio of a RebD/M-producing control strain.

TABLE 2

13-SMG transporter candidate expression and specificity.

| Transporter | | Relative Excretion (Transporter Knockout Strain Compared to RebD/M-Producing Control Strain) | Relative Expression Level (RebD/M-Producing Strain Compared to Control Strain) | | | | |
|---|---|---|---|---|---|---|---|
| Name | ORF | Supernatant/Total Ratio | 19 h | 43 h | 50 h | 72 h | 95 h |
| YVC1 | YOR087W (SEQ ID NO: 1, SEQ ID NO: 2) | 0.31 | 0.87 | 0.78 | 0.83 | 0.89 | 0.97 |
| YMD8 | YML038C (SEQ ID NO: 3, SEQ ID NO: 4) | 0.41 | 0.95 | 0.89 | 0.99 | 0.86 | 1.00 |
| TIM8 | YJR135W-A (SEQ ID NO: 5, SEQ ID NO: 6) | 0.44 | 1.98 | 1.22 | 1.68 | 2.00 | 3.30 |
| PDR15 | YDR406W (SEQ ID NO: 7, SEQ ID NO: 8) | 0.59 | 2.65 | 4.94 | 8.24 | 7.03 | 6.89 |
| DAL4 | YIR028W (SEQ ID NO: 9, SEQ ID NO: 10) | 0.67 | 11.12 | 15.86 | 12.97 | 13.94 | 9.92 |
| TPO2 | YGR138C (SEQ ID NO: 11, SEQ ID NO: 12) | 0.68 | 2.05 | 0.67 | 20.18 | 15.81 | 32.45 |
| HXT8 | YJL214W (SEQ ID NO: 13, SEQ ID NO: 14) | 0.69 | 18.90 | 11.64 | 23.55 | 17.37 | 38.28 |
| HXT3 | YDR345C (SEQ ID NO: 15, SEQ ID NO: 16) | 0.75 | 15.13 | 8.63 | 13.60 | 6.69 | 3.42 |

Example 2. Heterologous Expression of RebD and RebM Transporters

A RebD/M-producing strain disclosed in Example 1 was individually transformed using a standard LiAc method (see, e.g., Kawai et al., 2010, Bioeng Bugs. 1(6):395-403) with expression plasmids carrying transporter genes of the SET (sugar efflux transporter) and SWEET families. Steviol glycoside levels were measured using the LC-MS procedure described in Example 1, and $OD_{600}$ was measured using a Perkin Elmer 2104 Multilabel reader. FIGS. 2A, 2B, 2C, 2D, and 2E show changes in total and supernatant levels of RebA, RebB, RebD, RebM, and 13-SMG levels, respectively, upon expression of SetA from *E. coli* (SEQ ID NO:17, SEQ ID NO:18), SetB from *E. coli* (SEQ ID NO:19, SEQ ID NO:20), SetC from *E. coli* (SEQ ID NO:21, SEQ ID NO:22), SWEET from *Brassica rapa* (SEQ ID NO:23, SEQ ID NO:24), SWEET from *Petunia*×hybrid (SEQ ID NO:25, SEQ ID NO:26), or SWEET from *Triticum urartu* (SEQ ID NO:27, SEQ ID NO:28). The SET and SWEET family genes were also individually expressed in a steviol glycoside-producing strain comprising a higher copy number of SrKAHe1 (SEQ ID NO:191, SEQ ID NO:192), CPR8 (SEQ ID NO:193, SEQ ID NO:194), KO1 (SEQ ID NO:187, SEQ ID NO:188), UGT76G1 (SEQ ID NO:199, SEQ ID NO:200), EUGT11 SEQ ID NO:203, SEQ ID NO:204), and UGT91D2e-b (SEQ ID NO:201, SEQ ID NO:202) polypeptides. See FIGS. 2E, 2F, 2G, and 2H. Improved excretion of RebA, RebB, RebD, and RebM was observed in both strains, especially upon expression of SetA from *E. coli* (SEQ ID NO:17, SEQ ID NO:18), SWEET from *Brassica rapa* (SEQ ID NO:23, SEQ ID NO:24), or SWEET from *Triticum urartu* (SEQ ID NO:27, SEQ ID NO:28). See FIGS. 2A-2I.

Example 3. Deletion of Trafficking Adapter Genes

A range of adapter proteins are involved in secondary modification of transporter proteins. Art10 (SEQ ID NO:29, SEQ ID NO:30), Art1 (SEQ ID NO:31, SEQ ID NO:32), Art2 (SEQ ID NO:33, SEQ ID NO:34), Art3 (SEQ ID NO:35, SEQ ID NO:36), Art4 (SEQ ID NO:37, SEQ ID NO:38), Art6 (SEQ ID NO:39, SEQ ID NO:40), Art7 (SEQ ID NO:41, SEQ ID NO:42), Art8 (SEQ ID NO:43, SEQ ID NO:44), Bul1 (SEQ ID NO:45, SEQ ID NO:46), and Bul2 (SEQ ID NO:47, SEQ ID NO:48) were individually deleted in a steviol glycoside-producing strain comprising a recombinant gene encoding a *Synechococcus* sp. GGPPS7 polypeptide (SEQ ID NO:181, SEQ ID NO:182), a recombinant gene encoding a truncated *Zea mays* CDPS polypeptide (SEQ ID NO:183, SEQ ID NO:184), a recombinant gene encoding an *A. thaliana* KS5 polypeptide (SEQ ID NO:185, SEQ ID NO:186), a recombinant gene encoding a recombinant *S. rebaudiana* KO1 polypeptide (SEQ ID NO:187, SEQ ID NO:188), a recombinant gene encoding a KO polypeptide (SEQ ID NO:205, SEQ ID NO:206), recombinant gene encoding an *A. thaliana* ATR2 polypeptide (SEQ ID NO:189, SEQ ID NO:190), a recombinant gene encoding an SrKAHe1 polypeptide (SEQ ID NO:191, SEQ ID NO:192), a recombinant gene encoding an *S. rebaudiana* CPR8 polypeptide (SEQ ID NO:193, SEQ ID NO:194), a recombinant gene encoding an *S. rebaudiana* UGT85C2 polypeptide (SEQ ID NO:195, SEQ ID NO:196), a recombinant gene encoding an *S. rebaudiana* UGT74G1 polypeptide (SEQ ID NO:197, SEQ ID NO:198), a recombinant gene encoding an *S. rebaudiana* UGT76G1 polypeptide (SEQ ID NO:199, SEQ ID NO:200), a recombinant gene encoding an *S. rebaudiana* UGT91D2e-b polypeptide (SEQ ID NO:201, SEQ ID NO:202), and a recombinant gene encoding an *O. sativa* EUGT11 (SEQ ID NO:203, SEQ ID NO:204) polypeptide.

Deletion of the adapters was carried out by designing primers for PCR comprising a homology region upstream or downstream of the gene to be deleted and a sequence able to bind to a plasmid containing a selection marker. PCR was carried out on the plasmid comprising the selection marker yielding a hybrid DNA sequence comprising the selection marker flanked by upstream and downstream homology regions of the gene to be replaced by the selection marker. The generated PCR fragment was introduced to the RebD/M-producing strain by standard LiAc method and homologous recombination in yeast carried out to replace the endogenous gene with the selection marker. Selection of clones with the selection marker yielded strains with the gene of interest deleted.

The LC-MS method of Example 1 was used, and $OD_{600}$ was measured using a Perkin Elmer 2104 Multilabel reader to calculated steviol glycoside levels as $\mu M/OD_{600}$. The supernatant/total ratio of the adapter protein knockout strain was compared to the supernatant/total ratio of a control steviol glycoside-producing strain. Fold-change in steviol glycoside excretion for each transporter knockout strain, as compared to steviol glycoside excretion in a control steviol glycoside-producing strain, was calculated. More specifically, values below 1 correspond to a fold-decrease in steviol glycoside excretion compared to a steviol glycoside-producing control strain, values equal to 1 correspond to no fold-change in steviol glycoside excretion compared to a steviol glycoside-producing control strain, and values greater than 1 correspond to a fold-increase in steviol glycoside excretion compared to a steviol glycoside-producing control strain.

Several transporter deletions improved excretion of 13-SMG, RebA, RebB, RebD, and/or RebM in the steviol glycoside-producing strains. See FIGS. 3A, 3B, 3C, 3D, and 3E. Increased 13-SMG excretion resulted upon deletion of Art1 (SEQ ID NO:31, SEQ ID NO:32) (1.03), Art2 (SEQ ID NO:33, SEQ ID NO:34) (1.03), Art3 (SEQ ID NO:35, SEQ ID NO:36) (1.14), Art6 (SEQ ID NO:39, SEQ ID NO:40) (1.13), Art7 (SEQ ID NO:41, SEQ ID NO:42) (1.24), Art8 (SEQ ID NO:43, SEQ ID NO:44) (1.01), Art9 (SEQ ID NO:165, SEQ ID NO:166) (1.19), Art10 (SEQ ID NO:29, SEQ ID NO:30) (1.23), Bul1 (SEQ ID NO:45, SEQ ID NO:46) (1.32), Tre1 (SEQ ID NO:173, SEQ ID NO:174) (1.27), Ear1 (SEQ ID NO:169, SEQ ID NO:170) (1.31), Ssh4 (SEQ ID NO:171, SEQ ID NO:172) (1.26), or Bsd2 (SEQ ID NO:167, SEQ ID NO:168) (1.36), wherein the number in parentheses after each SEQ ID NO represents the fold-increase in 13-SMG excreted. Increased RebA excretion resulted upon deletion of Art1 (SEQ ID NO:31, SEQ ID NO:32) (1.26), Art2 (SEQ ID NO:33, SEQ ID NO:34) (1.18), Art3 (SEQ ID NO:35, SEQ ID NO:36) (1.30), Art4 (SEQ ID NO:37, SEQ ID NO:38) (1.12), Art6 (SEQ ID NO:39, SEQ ID NO:40) (1.14), Art7 (SEQ ID NO:41, SEQ ID NO:42) (1.38), Art8 (SEQ ID NO:43, SEQ ID NO:44) (1.04), Art9 (SEQ ID NO:165, SEQ ID NO:166) (1.22), Art10 (SEQ ID NO:29, SEQ ID NO:30) (1.38), Bul1 (SEQ ID NO:45, SEQ ID NO:46) (1.63), Bul2 (SEQ ID NO:47, SEQ ID NO:48) (1.08), Tre1 (SEQ ID NO:173, SEQ ID NO:174) (1.20), Ear1 (SEQ ID NO:169, SEQ ID NO:170) (1.36), or Ssh4 (SEQ ID NO:171, SEQ ID NO:172) (1.19), wherein the number in parentheses after each SEQ ID NO represents the fold-increase in RebA excreted. Increased RebB excretion resulted upon deletion of Art1 (SEQ ID NO:31, SEQ ID NO:32) (1.29), Art2 (SEQ ID NO:33, SEQ ID NO:34) (1.22), Art3 (SEQ ID NO:35, SEQ ID NO:36) (1.42), Art4 (SEQ ID NO:37, SEQ ID NO:38) (1.15), Art6 (SEQ ID NO:39, SEQ ID NO:40) (1.26), Art7 (SEQ ID NO:41, SEQ ID NO:42) (1.39), Art8 (SEQ ID NO:43, SEQ ID NO:44) (1.19), Art9 (SEQ ID NO:165, SEQ ID NO:166) (1.41), Art10 (SEQ ID NO:29, SEQ ID NO:30) (1.47), Bul1 (SEQ ID NO:45, SEQ ID NO:46) (1.67), Bul2 (SEQ ID NO:47, SEQ ID NO:48) (1.17), Tre1 (SEQ ID NO:173, SEQ ID NO:174) (1.30), Ear1 (SEQ ID NO:169, SEQ ID NO:170) (1.35), Ssh4 (SEQ ID NO:171, SEQ ID NO:172) (1.28), or Bsd2 (SEQ ID NO:167, SEQ ID NO:168) (1.12), wherein the number in parentheses after each SEQ ID NO represents the fold-increase in RebB excreted. Increased RebD excretion resulted upon deletion of Art3 (SEQ ID NO:35, SEQ ID NO:36) (1.05), Art7 (SEQ ID NO:41, SEQ ID NO:42) (1.05), Art9 (SEQ ID NO:165, SEQ ID NO:166) (1.06), Art10 (SEQ ID NO:29, SEQ ID NO:30) (1.05), or Bul1 (SEQ ID NO:45, SEQ ID NO:46) (1.25), wherein the number in parentheses after each SEQ ID NO represents the fold-increase in RebD excreted. Increased RebM excretion resulted upon deletion of Art1 (SEQ ID NO:31, SEQ ID NO:32) (1.50), Art2 (SEQ ID NO:33, SEQ ID NO:34) (1.48), Art3 (SEQ ID NO:35, SEQ ID NO:36) (1.66), Art4 (SEQ ID NO:37, SEQ ID NO:38) (1.54), Art6 (SEQ ID NO:39, SEQ ID NO:40) (1.40), Art7 (SEQ ID NO:41, SEQ ID NO:42) (1.64), Art8 (SEQ ID NO:43, SEQ ID NO:44) (1.21), Art9 (SEQ ID NO:165, SEQ ID NO:166) (1.66), Art10 (SEQ ID NO:29, SEQ ID NO:30) (1.75), Bul1 (SEQ ID NO:45, SEQ ID NO:46) (1.81), Bul2 (SEQ ID NO:47, SEQ ID NO:48) (1.51), Tre1 (SEQ ID NO:173, SEQ ID NO:174) (1.43), Ear1 (SEQ ID NO:169, SEQ ID NO:170) (1.50), or Ssh4 (SEQ ID NO:171, SEQ ID NO:172) (1.28), wherein the number in parentheses after each SEQ ID NO represents the fold-increase in RebM excreted.

Example 4. Deletion of Transporter Genes for Improved Production of Steviol Glycosides Deletion of a single transporter gene in one or two steviol glycoside-producing S. cerevisiae strains was carried out as described in Example 3. Each of the strains comprised a recombinant gene encoding a Synechococcus sp. GGPPS7 polypeptide (SEQ ID NO:181, SEQ ID NO:182), a recombinant gene encoding a truncated Zea mays CDPS polypeptide (SEQ ID NO:183, SEQ ID NO:184), a recombinant gene encoding an A. thaliana KS5 polypeptide (SEQ ID NO:185, SEQ ID NO:186), a recombinant gene encoding a recombinant S. rebaudiana KO1 polypeptide (SEQ ID NO:187, SEQ ID NO:188), a recombinant gene encoding an A. thaliana ATR2 polypeptide (SEQ ID NO:189, SEQ ID NO:190), a recombinant gene encoding an SrKAHe1 polypeptide (SEQ ID NO:191, SEQ ID NO:192), a recombinant gene encoding an S. rebaudiana CPR8 polypeptide (SEQ ID NO:193, SEQ ID NO:194), a recombinant gene encoding an S. rebaudiana UGT85C2 polypeptide (SEQ ID NO:195, SEQ ID NO:196), a recombinant gene encoding an S. rebaudiana UGT74G1 polypeptide (SEQ ID NO:197, SEQ ID NO:198), a recombinant gene encoding an S. rebaudiana UGT76G1 polypeptide (SEQ ID NO:199, SEQ ID NO:200), a recombinant gene encoding an S. rebaudiana UGT91D2e-b polypeptide (SEQ ID NO:201, SEQ ID NO:202), and a recombinant gene encoding an O. sativa EUGT11 (SEQ ID NO:203, SEQ ID NO:204) polypeptide and differed in the copy number of the genes encoding the GGPPS, truncated CDPS, KS, KO, ATR2, EUGT11, SrKAHe1, CPR8, UGT85C2, UGT74G1, UGT76G1, and EUGT11 polypeptides. Fold-change in steviol glycoside production for each transporter knockout strain, as compared to steviol glycoside production in a control steviol glycoside-producing strain, was calculated. More specifically, values below 1 correspond to a fold-decrease in steviol glycoside production compared to a steviol glycoside-producing control strain, values equal to 1 correspond to no fold-change in steviol glycoside production compared to a steviol glycoside-producing control strain, and values greater than 1 correspond to a fold-increase in steviol glycoside production compared to a steviol glycoside-producing control strain.

Several transporter deletions improved production of RebA, RebB, RebD, and/or RebM in the steviol glycoside-producing strains, as measured by the LC-MS method of Example 1. In a first steviol glycoside-producing strain, increased RebB production resulted upon deletion of YBR068C (SEQ ID NO:63, SEQ ID NO:64) (1.41), YBR220C (SEQ ID NO:65, SEQ ID NO:66) (3.91), YBR235W (SEQ ID NO:67, SEQ ID NO:68) (3.26), YBR293W (SEQ ID NO:69, SEQ ID NO:70) (2.35), YBR298C (SEQ ID NO:71, SEQ ID NO:72) (2.24), YCR011C (SEQ ID NO:73, SEQ ID NO:74) (3.98), YCR023C (SEQ ID NO:75, SEQ ID NO:76) (3.93), YDL100C (SEQ ID NO:77, SEQ ID NO:78) (2.14), YDL119C (SEQ ID NO:79, SEQ ID NO:80) (2.20), YDL138W (SEQ ID NO:81, SEQ ID NO:82) (3.51), YDL199C (SEQ ID NO:83, SEQ ID NO:84) (3.54), YDL210W (SEQ ID NO:85, SEQ ID NO:86) (2.64), YDR061W (SEQ ID NO:89, SEQ ID NO:90) (2.65), YDR135C (SEQ ID NO:91, SEQ ID NO:92) (2.82), YEL006W (SEQ ID NO:95, SEQ ID NO:96) (1.46), YFL028C (SEQ ID NO:97, SEQ ID NO:98) (3.00), YGL006W (SEQ ID NO:99, SEQ ID NO:100) (2.46), YGR125W (SEQ ID NO:103, SEQ ID NO:104) (2.73), YGR181W (SEQ ID NO:105, SEQ ID NO:106) (3.32), YIL088C (SEQ ID NO:107, SEQ ID NO:108) (3.05), YJR124C (SEQ ID NO:109, SEQ ID NO:110) (2.68), YPL134C (SEQ ID NO:111, SEQ ID NO:112) (2.01), YPR192W (SEQ ID NO:113, SEQ ID NO:114) (1.71), YPR194C (SEQ ID NO:115, SEQ ID NO:116) (1.99), YPR198W (SEQ ID NO:117, SEQ ID NO:118) (3.53), or YPR201W (SEQ ID NO:119, SEQ ID NO:120) (3.77), wherein the number in parentheses after each SEQ ID NO represents the fold-increase in RebB measured. Increases in RebD production resulted upon deletion of YBR220C (SEQ ID NO:65, SEQ ID NO:66) (1.50), YCR023C (SEQ ID NO:75, SEQ ID NO:76) (1.52), YDR508C (SEQ ID NO:93, SEQ ID NO:94) (1.53), YGL114W (SEQ ID NO:101, SEQ ID NO:102) (1.47), YPL134C (SEQ ID NO:111, SEQ ID NO:112) (1.61), or YPR201W (SEQ ID NO:119, SEQ ID NO:120) (1.41), wherein the number in parentheses after each SEQ ID NO represents the fold-increase in RebD measured. Increased RebM production resulted upon deletion of YDL138W (SEQ ID NO:81, SEQ ID NO:82) (1.53), YDL245C (SEQ ID NO:87, SEQ ID NO:88) (1.41), or YDR508C (SEQ ID NO:93, SEQ ID NO:94) (1.54), wherein the number in parentheses after each SEQ ID NO represents the fold-increase in RebM measured.

In a second steviol glycoside-producing strain, which comprised a higher copy number of genes encoding GGPPS, truncated CDPS, KS, KO, ATR2, EUGT11, SrKAHe1, CPR8, UGT85C2, UGT74G1, UGT76G1, and EUGT11 polypeptides, increased RebA production resulted upon deletion of YBR235W (SEQ ID NO:67, SEQ ID NO:68) (1.66), YCR023C (SEQ ID NO:75, SEQ ID NO:76) (1.75), YDL100C (SEQ ID NO:77, SEQ ID NO:78) (1.67), YDL138W (SEQ ID NO:81, SEQ ID NO:82) (1.58), YDR438W (SEQ ID NO:127, SEQ ID NO:128) (1.51), YGL084C (SEQ ID NO:131, SEQ ID NO:132) (1.72), YGL114W (SEQ ID NO:101, SEQ ID NO:102) (1.93), YGR224W (SEQ ID NO:135, SEQ ID NO:136) (1.56), or YJL093C (SEQ ID NO:53, SEQ ID NO:54) (1.49), wherein the number in parentheses after each SEQ ID NO represents the fold-increase in RebA measured. Increased RebB production resulted upon deletion of YBR235W (SEQ ID NO:67. SEQ ID NO:68) (1.47), YCR023C (SEQ ID NO:75, SEQ ID NO:76) (1.43), YDL100C (SEQ ID NO:77, SEQ ID NO:78) (1.50), YDL138W (SEQ ID NO:81, SEQ ID NO:82) (1.49), YGL084C (SEQ ID NO:131, SEQ ID NO:132) (1.61), YGL114W (SEQ ID NO:101, SEQ ID NO:102) (1.70), wherein the number in parentheses after each SEQ ID NO represents the fold-increase in RebB measured. Increased RebD production resulted upon deletion of YAL067C (SEQ ID NO:121, SEQ ID NO:122) (1.66), YBL089W (SEQ ID NO:123, SEQ ID NO:124) (1.58), YBR220C (SEQ ID NO:65, SEQ ID NO:66) (1.77), YBR235W (SEQ ID NO:67, SEQ ID NO:68) (2.06), YCR011C (SEQ ID NO:73, SEQ ID NO:74) (1.45), YCR023C (SEQ ID NO:75, SEQ ID NO:76) (1.99), YCR028C (SEQ ID NO:125, SEQ ID NO:126) (1.61), YDL100C (SEQ ID NO:77, SEQ ID NO:78) (2.13), YDL138W (SEQ ID NO:81, SEQ ID NO:82) (1.94), YDL199C (SEQ ID NO:83, SEQ ID NO:84) (1.65), YDR438W (SEQ ID NO:127, SEQ ID NO:128) (1.84), YFL011W (SEQ ID NO:129, SEQ ID NO:130) (1.48), YGL006W (SEQ ID NO:99, SEQ ID NO:100) (1.71), YGL084C (SEQ ID NO:131, SEQ ID NO:132) (2.17), YGL104C (SEQ ID NO:133, SEQ ID NO:134) (1.78), YGL114W (SEQ ID NO:101, SEQ ID NO:102) (2.55), YGR125W (SEQ ID NO:103, SEQ ID NO:104) (1.67), YGR224W (SEQ ID NO:135, SEQ ID NO:136) (1.79), YHR032W (SEQ ID NO:137, SEQ ID NO:138) (1.59), YJL093C (SEQ ID NO:53, SEQ ID NO:54) (1.74), YMR034C (SEQ ID NO:139, SEQ ID NO:140) (1.43), YNR055C (SEQ ID NO:141, SEQ ID NO:142) (1.86), YOL020W (SEQ ID NO:143, SEQ ID NO:144) (1.16), or YOL075C (SEQ ID NO:145, SEQ ID NO:146) (1.41), wherein the number in parentheses after each SEQ ID NO represents the fold-increase in RebD measured. Increased production of RebM resulted upon deletion of YBR235W (SEQ ID NO:67, SEQ ID NO:68) (1.73), YCR023C (SEQ ID NO:75, SEQ ID NO:76) (1.55), YCR028C (SEQ ID NO:125, SEQ ID NO:126) (1.69), YDL100C (SEQ ID NO:77, SEQ ID NO:78) (1.88), YDL138W (SEQ ID NO:81, SEQ ID NO:82) (1.67), YDR438W (SEQ ID NO:127, SEQ ID NO:128) (1.56), YGL006W (SEQ ID NO:99, SEQ ID NO:100) (1.58), YGL084C (SEQ ID NO:131, SEQ ID NO:132) (1.56), YGL104C (SEQ ID NO:133, SEQ ID NO:134) (1.62), YGL114W (SEQ ID NO:101, SEQ ID NO:102) (2.29), or YGR224W (SEQ ID NO:135, SEQ ID NO:136) (1.43), wherein the number in parentheses after each SEQ ID NO represents the fold-increase in RebM measured.

TABLE 3

Sequences disclosed herein.

```
SEQ ID NO: 1
atggtatcag ccaacggcga cttgcacttg ccaatttcta acgaacagtg catgccggaa      60
aacaatggat ctcttggatt tgaggccccc actccgagac agattctcag ggttacgtta     120
aatttgaaat acttaattga taaggtcgta cctattgttt acgatcccaa tgatattgtt     180
tgtgaccatt ctgagatttt atctccaaaa gttgtgaagc tggcttatga agcatgtggc     240
gggaaccctaagcagatgca gcaacaaaaga aaatatcaat ctgtcattat tttttcactt     300
cttaaagttt gtgagtggta ttccatattg gccactatgg aagtgcacaa tgccaaactt     360
tacgaaacca gaaatttagc ctcacaacag ttatgtaaat tgttaattga aggggaggag     420
acaagagacc tgcagtttct tttcatgcag ttactgctgc gtcggtacgt aatcaacgag     480
aacgatgaag atcaagaacc gttgaacttg ccacagatat gcactgtact               540
acagtgatag gatcgagtgg atttcagcgt tgtttaaaat ggatatggag aggatggata     600
gtccaaaatg gcttggatcc cacaactttt atcaaggacg attcactggc ggaagtgtca     660
ttgatctctc atttcaaccc cgtaagatta aaggcgcctg tataccaaaa ttatttgcag     720
atgatcttct cattttttgtt tctagggctt tataccttgg tggttaatgg taaggactct     780
gagagagtcc aatctttcga tttgttagaa agcatatttt atgttttcaa tactggtttc     840
atcttggatg agctcactaa gctttattat attggttatg cgcacctatc gttttggaat     900
ttatttaatg ataccacata tttgataatc acgtttgcta tggggttccg tgcaatgagc     960
gtaacgcccc ttaatgcaaa atactcttca gaagattggg ataaaatatc atatagagtc    1020
ttatcctgtg cagcaccatt tgtgtggtcg agactcctac tataccttga atcacaaagg    1080
tttattggga ttatgttggt tatcctaaaa catatgatga aagaatccat tgtattttc     1140
ttccttctat tcttaataat gataggattc actcaaggtt tcttaggttt ggattccgca    1200
gatggtaaga gagatatcac cggacccatc ctgggtaatt taacaatcac cgtttgggt    1260
cttggtagtt ttgatgtttt cgaagaattc gctcccccat atgcggcaat actgtattat    1320
ggttactatt ttattgtttc ggttatcctt ttgaatatat taattgcttt gtattcgact    1380
gcgtaccaaa aagttattga caatgcagat gacgagtaca tggctttgat gtcacaaaag    1440
acgttgagat acattagagc acctgatgaa gatgtctatg tttctccatt gaacttaatt    1500
gaagtgttca tgacacctat ctttcgtatt cttccaccga agcgtgctaa agattgagc     1560
tatactgtaa tgacaatagt gtacagccca tttttgttgc ttattctgt taaagaaact    1620
cgggaggcta gaaggataaa atataacagg atgaaaaggt taacgatga tgccaatgaa    1680
tatgatactc catgggattt gacagatggc tacttggatg atgatgacgg tttgtttct     1740
gataaccgaa attctggcat gagagccacc cagttaaaga attcccgttc gctaaaactg    1800
caaagaacag cagagcagga agatgtccat tttaaagtcc ctaagaagtg tataaaaac    1860
gttaaaaaat gcagtccctc cttcgaacag tatgataacg atgacactga agatgatgct    1920
ggtgaagata aagatgaagt caaagagctc actaagaaag tggaaaactt gacagctgta    1980
attaccgatc tactcgaaaa attagacata aaggataaga aagagtaa                 2028

SEQ ID NO: 2
MVSANGDLHL PISNEQCMPE NNGSLGFEAP TPRQILRVTL NLKYLIDKVV PIVYDPNDIV      60
CDHSEILSPK VVKLAYEACG GNPKDKANKR KYQSVIIFSL LKVCEWYSIL ATMEVHNAKL     120
YETRNLASQQ LCKLLIEREE TRDLQFLFMQ LLLRRYVINE NDEDQEPLNA LELATDMHCT     180
TVIGSSGFQR CLKWIWRGWI VQNGLDPTTF IKDDSLAEVS LISHFNPVRL KAPVYQNYLQ     240
```

TABLE 3-continued

Sequences disclosed herein.

```
MIFSFLFLGL YTLVVNGKDS ERVQSFDLLE SIFYVFNTGF ILDELTKLYY IGYAHLSFWN    300
LFNDTTYLII TFAMGFRAMS VTPLNAKYSS EDWDKISYRV LSCAAPFVWS RLLLYLESQR    360
FIGIMLVILK HMMKESIVFF FLLFLIMIGF TQGFLGLDSA DGKRDITGPI LGNLTITVLG    420
LGSFDVFEEF APPYAAILYY GYYFIVSVIL LNILIALYST AYQKVIDNAD DEYMALMSQK    480
TLRYIRAPDE DVYVSPLNLI EVFMTPIFRI LPPKRAKDLS YTVMTIVYSP FLLLISVKET    540
REARRIKYNR MKRLNDDANE YDTPWDLTDG YLDDDDGLFS DNRNSGMRAT QLKNSRSLKL    600
QRTAEQEDVH FKVPKKWYKN VKKCSPSFEQ YDNDDTEDDA GEDKDEVKEL TKKVENLTAV    660
ITDLLEKLDI KDKKE                                                    675

SEQ ID NO: 3
atgaatagga ctgtcttttt ggcatttgta tttggatggt atttctgttc aatagctctc     60
tccatataca atagatggat gttcgatccg aaggacggat tgggtattgg gtatcccgtg    120
ttggtgacaa cattccatca ggctacttta tggttactat ccggcatata cattaagctc    180
aggcataagc cagtgaaaaa cgttttaaga agaataatg gttttaactg gagttttttt    240
ctaaaatttt tactccctac ggcagtcgct tctgcaggtc atatcgggct cagtaacgtt    300
tccttccagt atgttccctt gacaatttat acaattatca aatcttcgag catagctttt    360
gtcctttat tcggctgtat cttcaagcta gaaaagtttc attggaagtt ggcactttca    420
gtaataatta tgtttgttgg tgtagcatta atggttttca aaccaagcga ttccaccagt    480
accaaaaacg accaagcctt ggtcattttt ggcagctttc ttgtcctagc aagtagctgt    540
ctttctgggt taaggtgggt ttatacgcag ttgatgctta ggaacaaccc aattcaaact    600
aacaccgctg cagcagtaga ggaatctgat ggtgccctt tcacgaaaa tgaagataat    660
gtcgataatg aacctgttgt taacctcgcc aataacaaaa tgctggagaa ttttggagaa    720
tccaagcctc acccaattca tataatccac cagttagctc ctataatggg cattactgtg    780
ttgcttacct cgctacttgt ggaaaaacca tttcctggta tattcagctc tagcatattt    840
aggcttgata cgagcaatgg cggtgtcggc acggaaacta ccgtcctatc cattgtgagg    900
ggtattgttt tgttaatttt acctggtttt gcagtctttt tgttgacaat ttgtgagttt    960
agtattttgg agcaaacgcc cgtgctgacc gtatctattg tgggtatagt gaaggaactt   1020
ttgacggtaa tatttggtat aattattctt tctgaaagat taagtggttt ttacaattgg   1080
ttaggaatgc ttattattat ggcagatgta tgctattata attacttcag atataagcaa   1140
gatctattac aaaaatatca ttcagtttcg acacaagata atcgtaacga gttaaaggga   1200
tttcaagact tcgaacagtt aggaagcaag aaaatcgcac atattctat tagtgtcgac   1260
ctaacaaatc aagagtatga gcttgatatg attgctcaaa acgttagtcg ttcatcccag   1320
caggtctga                                                          1329

SEQ ID NO: 4
MNRTVFLAFV FGWYFCSIAL SIYNRWMFDP KDGLGIGYPV LVTTFHQATL WLLSGIYIKL    60
RHKPVKNVLR KNNGFNWSFF LKFLLPTAVA SAGDIGLSNV SFQYVPLTIY TIIKSSSIAF   120
VLLFGCIFKL EKFHWKLALS VIIMFVGVAL MVFKPSDSTS TKNDQALVIF GSFLVLASSC   180
LSGLRWVYTQ LMLRNNPIQT NTAAAVEESD GALFTENEDN VDNEPVVNLA NNKMLENFGE   240
SKPHPIHTIH QLAPIMGITL LLTSLLVEKP FPGIFSSSIF RLDTSNGGVG TETTVLSIVR   300
GIVLLILPGF AVFLLTICEF SILEQTPVLT VSIVGIVKEL LTVIFGIIIL SERLSGFYNW   360
LGMLIIMADV CYYNYFRYKQ DLLQKYHSVS TQDNRNELKG FQDFEQLGSK KIAPYSISVD   420
LTNQEYELDM IAQNVSRSSQ QV                                            442

SEQ ID NO: 5
atgtcttctc tatcaacgtc tgatttggcc tcccttgatg acacttccaa aaaggaaatt     60
gctacttttc tggagggaga gaactccaaa caaaaagtcc agatgtcaat ccatcaattc    120
actaatatat gcttcaaaaa atgtgttgag tctgtcaatg attctaattt aagttcgcaa    180
gaagagcaat gtttgtctaa ctgtgtgaat cggttttgg atactaatat caggattgtg    240
aacgggttgc aaaacacccg ttaa                                           264

SEQ ID NO: 6
MSSLSTSDLA SLDDTSKKEI ATFLEGENSK QKVQMSIHQF TNICFKKCVE SVNDSNLSSQ    60
EEQCLSNCVN RFLDTNIRIV NGLQNTR                                       87

SEQ ID NO: 7
atgtcatcag atatcagaga cgtagaggaa cgaaattcgc ggagctcgag ctcaagctcg     60
agctcgaact ctgccgccca atccattgga cagcatccat accgcggttt cgacagcgaa    120
gccgcggaaa gggtgcatga gttggctaga cactcacat cgcagagttt actatacact    180
gctaactcaa caatagctc ttccagcaac cataatgcgc acaatgcgga ctcgagatcc    240
gtattttcta cggacatgga aggtgtgaac ccggtgttca taacccgga cacccccgga    300
tacaatccca aattggaccc taacagtgat caattctcca gtacggcgtg ggtacagaac    360
atggcaaata tttgtacttc ggaccccgat ttctataaac catactcact cggttgtgta    420
tggaagaatc taagcgcctc cggagactcc gccgatgtgt cataccagtc aactttcgct    480
aacatcgtac caaagctgct tacgaaaggg tcagattac tgaagcccaa taaagaagag    540
gacactttc agatcctgaa acccatggat ggttgtctta atcccggtga actgttggtt    600
gttcttggga gaccagggtc aggttgtact acgctgctaa aatccatatc ttctaattcg    660
cacgggttca agatcgcaaa agactccatt gtctcttaca acgtttgtc aagctcggat    720
atcaggaaac attactggg tgaagtcgtt tacaatgcgg aatcagatat tcatttaccg    780
catcttaccg tgtaccagac gcttttcacc gtgcaagga tgaaaacgcc gcaaaatcgt    840
atcaaggtgt tgatagaga agcgtacgcc aatcacgtga cagaagttgc aatgccaca    900
tatggtcttt cgcatacaag ggacaccaag gtcgaaacg atctagtcag aggtgtttct    960
ggtggtcaga gaaagcgtgt atccattgcg gaagtcgac tcgcggcgc cagatttcaa   1020
tgttggggata atgccaccag aggtttggac tctgctactg ctttagaatt catccgtgat   1080
ttaaaaaccc aggctgacat tgggaagacc gcgctactg tggccatcta tcaatgttct   1140
caggatgctt atgatctttt tgataaggtc tgtgtcctgg atgatggtta ccagcttat   1200
tttgggcccg ctaaggatgc aaagaaatat ttccaagaca tgggctacta ttgtcctccc   1260
agacagacca ctgcagattt tttaacttca attacaagtc ctactgaaag aattattagc   1320
```

TABLE 3-continued

Sequences disclosed herein.

```
aaagaattta tcgaaaaagg tactagagtg cctcaaacgc caaaggatat ggccgaatat    1380
tggctacaat cagaaagcta caaaaattta atcaaggata tagactctac attagagaaa    1440
aacacagatg aagcacgcaa tattatcagg gatgctcacc acgctaaaca ggcaaaaagg    1500
gcaccacctt cctctccata cgttgtcaac tacggaatgc aagtcaaata cttgttgatt    1560
agaaatttct ggagaatgaa gcaaagtgct agtgttactt tgtggcaagt catcggtaac    1620
tctgtcatgg ctttcatctt gggttctatg ttttataaag tgatgaagaa aaacgatact    1680
tccacttttct atttccgtgg tgctgcaatg ttttttgcta ttttatttaa tgcattttcg    1740
tgtcttttgg aaatctttag tttgtatgaa acaagaccta taactgaaaa acacagaact    1800
tattccttgt atcatccaag cgctgacgca tttgcgtctg ttttgtcaga aatgccgcca    1860
aaattgatca ctgctgtctg cttcaacatc atcttttatt tcctagttga tttcaggaga    1920
aacggtggtg tcttttcctt ttattttta attaatgtca ttgccacatt cactttatcc    1980
catttattta gatgcgtggg ctccttgacc aaaacattac aggaggccat ggtccccgct    2040
tcaatgttat tattggcaat ttctatgtat acagggtttg ccatccctaa aacgaagatt    2100
ttaggttggt ccatttggat ttggtatatc aacccgctag cctacctgtt tgaatcttta    2160
atgatcaatg aattccatga ccgtagattc ccttgtgccc aatacatccc tgctggccct    2220
gcttatcaga acatcacagg tactcaacgc gtctgttccg cagttggtgc ttatccaggt    2280
aacgactatg tgttgggtga tgacttcttg aaggaaagtt acgattatga gcacaaacat    2340
aagtggcgtg ggttcggtat tggtatggca tatgttgttt tctttttctt tgtttatcta    2400
attctttgtg agtataatga aggtgctaaa caaaagggtg aaatggttgt gttcctaaga    2460
tctaagatca agcaattgaa aaaggaaggt aaattacaag aaaagcatag gcctggagat    2520
attgaaaata atgcaggcag ttccccagat tccgctacaa cagaaaaaaa aatactagat    2580
gatagttctg agggatcgga tagctcttca gataatgccg gattaggact ttccaaatct    2640
gaagcaattt tccactggcg tgatttatgc tatgatgttc ctataaaagg aggtcaaaga    2700
cgtatcttaa ataacgtaga tggttgggta aaaccaggca ctttgactgg cttaatgggg    2760
gcgtcaggtg caggtaaaac aactttactg gattgtttgg ctgaaagagt caccatgggt    2820
gttattactg gtaatatttt tgtcgatggt cgtctccgtg acgaatcatt ccctagatct    2880
attggttatt gtcaacaaca ggatttacat ttgaaaacgg tacagtagat agaatctttg    2940
agattttcag cttatttacg tcagccttcg tcagttttcta ttgaagaaaa aaataggtac    3000
gtggaagaag ttatcaaaat tttggaaatg caacaatatt cagatgctgt tgttggtgtt    3060
gcaggtgaag gtctaaatgt cgaacaaaga aaaagactta ctattggtgt tgaactagcg    3120
gcaaggccta aacttttggt tttttggat gaaccaactt caggcctgga ttcacaaact    3180
gcttgggaca cttgccaact tatgaggaaa ctagctaccc acggtcaagc aattttgtgt    3240
actatccatc aaccttctgc tatattaatg cagcagtttg atagattatt attttttacag    3300
aaaggggggcc aaactgtata tttcggcgat ttaggtgaag ggtgcaaaac tatgatcgat    3360
tatttttgaaa gtaaaggagc tcacaaatgt ccacctgatg caaaccctgc cgaatggatg    3420
ttagaggttg taggtgccgc tcctggttct cacgctacgg aagattataa tgaagtctgg    3480
agaaactcag atgaatacaa agctgttcag gaagaattgg attggatgga aaagaattta    3540
ccaggcaggt caaagaaacc aactgcagaa gaacataaac cttttgctgc atctttatac    3600
taccaattta aaaatggttac cattcgtttg ttccaacaat actggagatc accagattat    3660
ttatgtcga aattttatttt gactattttc aaccaagttt ttattgggtt cacttttttc    3720
aaggctgaca gaagtttaca gggactacaa aaccaaatgt tatcaatatt catgtatacg    3780
gttattttca atcctatact acaacagtat ctaccatctt tcgtcagcaa aagggatttg    3840
tatgaggcaa gagaacgtcc ttcaagaaca ttttcgtggc ttgcgttttt cctctctcaa    3900
atcattgttg aaatcccatg gaatatttta gcgggtacga ttgcttattg tatttactat    3960
tacgcggttg gattttatgc gaacgcctca gctgctggtc aactccatga gagaggtgct    4020
ttgtttggtt tattttctat tgccttctac gtctacattg gttcgatggg tttgttaatg    4080
atttctttca atgaagttgc tgaaacagcg gcacatatgg gaacgctatt gttcacgatg    4140
gcattatctt tctgtggtgt tatggctacc cctaaggtta tgccaagatt ttggatcttt    4200
atgtatagag tgtcacccct aacttatatg atcgatgcat tattagccct tggtgtggct    4260
aatgtggacg ttaagtgttc aaattatgaa atggtaaaat ttactccacc atctggaacc    4320
acctgcggtg actatatggc atcatatatc aagttggccg aacaggcta cttgagtgac    4380
ccgtctgcaa cagatatatg tagttttctgt gcggtatcca ccaccaatgc ctttttggcc    4440
actttcagtt ctcattatta cagaagatgg agaaattacg gtattttat ctgctatatt    4500
gcttttgatt atatcgctgc aacattcttg tattggttat ccagggtacc caagaagaac    4560
ggtaagattt ccgaaaaacc caagaagtga                                     4590
```

```
SEQ ID NO: 8
MSSDIRDVEE RNSRSSSSSS SSNSAAQSIG QHPYRGFDSE AAERVHELAR TLTSQSLLYT     60
ANSNNSSSSN HNAHNADSRS VFSTDMEGVN PVFTNPDTPG YNPKLDPNSD QFSSTAWVQN    120
MANICTSDPD FYKPYSLGCV WKNLSASGDS ADVSYQSTFA NIVPKLLTKG LRLLKPSKEE    180
DTFQILKPMD GCLNPGELLV VLGRPGSGCT TLLKSISSNS HGFKIAKDSI VSYNGLSSSD    240
IRKHYRGEVV YNAESDIHLP HLTVYQTLFT VARMKTPQNR IKGVDREAYA NHVTEVAMAT    300
YGLSHTRDTK VGNDLVRGVS GGERKRVSIA EVAICGARFQ CWDNATRGLD SATALEFIRA    360
LKTQADIGKT AATVAIYQCS QDAYDLFDKV CVLDDGYQLY FGPAKDAKKY FQDMGYYCPP    420
RQTTADFLTS ITSPTERIIS KEFIEKGTRV PQTPKDMAEY WLQSESYKNL IKDIDSTLEK    480
NTDEARNIIR DAHHKAQAKR APPSSPYVVN YGMQVKYLLI RNFWRMKQSA SVTLWQVIGN    540
SVMAFILGSM FYKVMKKNDT STFYFRGAAM FFAILFNAFS CLLEIFSLYE TRPITEKHRT    600
YSLYHPSADA FASVLSEMPP KLITAVCFNI IFYFLVDFRR NGGVFFFYFL INVIATFTLS    660
HLFRCVGSLT KTLQEAMVPA SMLLLAISMY TGFAIPKTKI LGWSIWIWYI NPLAYLFESL    720
MINEFHDRRF PCAQYIPAGP AYQNITGTQR VCSAVGAYPG NDYVLGDDFL KESYDYEHKH    780
KWRGFGIGMA YVFFFFVYL ILCEYNEGAK QKGEMVVFLR SKIKQLKKEG KLQEKHRPGD    840
IENNAGSSPD SATTEKKILD DSSEGSDSSS DNAGLGLSKS EAIFHWRDLC YDVPIKGGQR    900
RILNNVDGWV KPGTLTALMG ASGAGKTTLL DCLAERVNGM VITGNIFVDG RLRDESFPRS    960
IGYCQQQDLH LKTATVRESL RFSAYLRQPS SVSIEEKNRY VEEVIKILEM QQYSDAVVGV   1020
AGEGLNVEQR KRLTIGVELA ARPKLLVFLD EPTSGLDSQT AWDTCQLMRK LATHGQAILC   1080
TIHQPSAILM QQFDRLLFLQ KGGQTVYFGD LGEGCKTMID YFESKGAHKC PPDANPAEWM   1140
LEVVGAAPGS HATQDYNEVW RNSDEYKAVQ EELDWMEKNL PGRSKEPTAE EHKPFAASLY   1200
YQFKMVTIRL FQQYWRSPDY LWSKFILTIF NQVFIGFTFF KADRSLQGLQ NQMLSIFMYT   1260
```

TABLE 3-continued

| Sequences disclosed herein. | | | | | |
|---|---|---|---|---|---|
| VIFNPILQQY | LPSFVQQRDL | YEARERPSRT | FSWLAFFLSQ | IIVEIPWNIL | AGTIAYCIYY | 1320 |
| YAVGFYANAS | AAGQLHERGA | LFWLFSIAFY | VYIGSMGLLM | ISFNEVAETA | AHMGTLLFTM | 1380 |
| ALSFCGVMAT | PKVMPRFWIF | MYRVSPLTYM | IDALLALGVA | NVDVKCSNYE | MVKFTPPSGT | 1440 |
| TCGDYMASYI | KLAGTGYLSD | PSATDICSFC | AVSTTNAFLA | TFSSHYYRRW | RNYGIFICYI | 1500 |
| AFDYIAATFL | YWLSRVPKKN | GKISEKPKK | | | | 1529 |

SEQ ID NO: 9
```
atggctaacg acgctctaag tgctatttc agtaatcctt cgaggaaagg tgtccaaccc    60
tccacatcta ttgtgtcata tacaaacaat gaagatgata ttatagatgt ggaaaatggg   120
aagttcaaca agaacaagaa tatcaacact aatgtgtatg tggacaactc ctcaatagag   180
gagagcgaag tcgtgccctt gcccgaaaca aagtccatct ggagtaaaat atactacgat   240
ttcattgtgt tagacaagac aactttgaat gtttcgttga aagagtcgtt cttgtataac   300
agagacttga aaccggttga agaagaaaga aggtgttggt cctggttcaa ttacttatat   360
ttctggctgg cagactgttt caatattaac acatggcaaa tagctggtac aggtctacaa   420
ctaggtctga attggtggca atgttggctt acagtttgga tcggctacac ttttgcaggt   480
atcttcgtag tattgaactc gagatttggt tccgcatatc acttatcttt ccctattact   540
gttagggcct catttggtat attctttct atgtggccga ttataaatcg tgtcgtgatg   600
gctatagtat ggtatgccgt gcaagcctgg ttaggtgcaa cgcccgtggc actgatgcta   660
aaatctattt ttggcaagaa tctggaagat agaatcccaa accattttgg ttctccaaat   720
agcactactt ttgaattcat gtgtttcttt atattttggg tggtcagtat accatttgtc   780
ctagtggctc ctcataaaat caggcattta ttcacagtaa aagcagcttt gatcccttc    840
gcagcctttg gattttaat ctgggctttg aagaaatcgc acggtaaaat tgagttgggg   900
acgctgaatg attattcacc tcatggttcc gaatttttcat ggatattcgt tagatcccta   960
atggcctgtg ttgctaactt tgccgctttg attatcaacg cccctgactt cggtagattt  1020
gccaaaaatc ctcaagcgtc tttgtggcca caattggttg ccatcccatt gttcttcgcc  1080
ataacatgtt tgatcggtat cattgttact gcggccggtt atcacttata tggggttaac  1140
tattggtcac cactggatgt acttggtcaa tttttggaga cacttacac cagaggtact  1200
agggctggtg tgttcttgat ttctttgta tttgcctag ctcaactggg tacaaacatt  1260
tctgccaact ctctggcatg tggtgctgat atgacggctt gtttccaag atatattaat  1320
attagaagag gttctttatt ctgtgtggca atggctctat gtatctgtcc atggaactta  1380
atggccagtt caagtaagtt caccagcgct ttgggtgctt atgcaatttt cctttccagt  1440
attgctggtg tcatttgcgc ggattatttc gtagtaagaa gaggatatgt gaaattaaca  1500
catttattcc tggcacagaa gggttccttt tacatgtttg gaaacaaatt tggtgccaat  1560
tggagggcct ttgttgcgta tatttgcggt atcgctccaa atttaccagg ttttataggt  1620
gatgttggag ctccaaaaat tacggttca gagggtgcaa tgaggttata ctatttaggt  1680
tatccggtag gtttcttat tagtcggtg atataccta tattatgtta tctttttcct  1740
gtccctggta ctcccgtaac caattttctg acagagaaag gatggttcca aagatgggct  1800
tatgttgagg acttcgagca agattggaag aatgagttac gtaggatga cctctgcgat  1860
gacacagtca gtatctatga tggcaccgag gaaaagatag tttactaa              1908
```

SEQ ID NO: 10
```
MANDALSAIF SNPSRKGVQP STSIVSYTNN EDDIIDVENG KFNKNKNINT NVYVDNSSIE    60
ESEVVPLPET KSIWSKIYYD FIVLDKTTLN VSLKESFLYN RDLKPVEEER RCWSWFNYLY  120
FWLADCFNIN TWQIAGTGLQ LGLNWWQCWL TVWIGYTFAG IFVVLNSRFG SAYHLSFPIT  180
VRASFGIFFS MWPIINRVVM AIVWYAVQAW LGATPVALML KSIFGKNLED RIPNHFGSPN  240
STTFEFMCFF IFWVVSIPFV LVAPHKIRHL FTVKAALIPF AAFGFLIWAL KKSHGKIELG  300
TLNDYSPHGS EFSWIFVRSL MACVANFAAL IINAPDFGRF AKNPQASLWP QLVAIPLFFA  360
ITCLIGIIVT AAGYHLYGVN YWSPLDVLGQ FLETTYTRGT RAGVFLISFV FALAQLGTNI  420
SANSLACGAD MTALFPRYIN IRRGSLFCVA MALCICPWNL MASSSKFTSA LGAYAIFLSS  480
IAGVICADYF VVRRGYVKLT HLFLAQKGSF YMFGNKFGAN WRAFVAYICG IAPNLPGFIG  540
DVGAPKITVS EGAMRLYYLG YPVGFFISAV IYLILCYFFP VPGTPVTNFL TEKGWFQRWA  600
YVEDFEQDWK NELRRDDLCD DTVSIYDGTE EKIVY                              635
```

SEQ ID NO: 11
```
atgagtgatc aagaatctgt tgtttcattc aactcacaaa acacttccat ggtggacgtt    60
gagggccaac aacctcaaca gtatgtcccc tcaaaaacca actctcgtgc aaatcaactt   120
aagttaacta agactgagac cgtcaagtct ttacaagatt taggtgtcac ttcagccgcc   180
ccagtgcctg atatcaatgc gccacaaact gctaagaata acattttccc tgaagaatat   240
accatggaaa caccatctgg gctggttcca gtggctacct acaatctat gggtagaacc   300
gcctctgcct atctcgtac tagaacaaag caattgaacc gtaccgctac caattcctca   360
tccacaggta agaagaaat ggaagaggaa aaactgaaga aacgtgaaga cagagcggt   420
gaaaacgagc tagatccaga gatcgaattc gttacttttg ttactggtga tccagaaaac   480
cctcacaatt ggccctcatg ggttcgttgg agttacactg tcctgttgtc catcttagtt   540
atttgcgttg cctacggttc tgcttgtatc agtggtgggt tgggaaccgt tgaaaagaaa   600
taccatgtag gtatggaagc cgctatttta tcatgtttt taatgattgt tgggttctgt   660
ctgggtcctt tgatttggtc tcctgttagt gatcttacg gtagaagagt tgcttacttt   720
gtttctatgg gtctttatgt catccttaat tccctgcg cctagctcc aaatctaggt   780
tgtctttag cttgtagatt tttatgtggt gtttggtcat catctggttt tgtttagtt   840
ggtgggtcta ttgccgatat gttcccaagt gaaacaagag gtaaggctat tgctttctc   900
gcttttgctc cttacgttgg tcccgttgtt ggtccactag ttaacggttt tatttccgtt   960
tctaccggac gtatgaccct gattttctgg gtcaatatgg cctttgcagg tgttatgtgg  1020
atcatatctt ctgccatccc agaaacgtac gctccagtta tcttgaagag aaaggctgct  1080
agattaagaa ggaaactgg taatcccaag attatgacta agcaggaagc gcaaggtgtc  1140
agtatgagtg aaatgatgag ggcttgtctg ttgagacctt tgtacttcgc tgtcactgca  1200
cctgttctag ttgccacttg tttctacgtg tgttgattt actctctact atatgcgttc  1260
ttctttgcct tccctgtcat tttcggtgaa ctatatggct acaaagataa ccttgtgggt  1320
ttaatgttta ttcctattgt tatcggtgct ctttgggcgt tagccacaac tttctactgt  1380
gaaaacaaat atttacaaat tgtcaaacag cgtaaaccta ctcctgaaga tcgtttgcta  1440
```

TABLE 3-continued

Sequences disclosed herein.

```
ggtgctaaga tcggtgctcc atttgctgca attgctctat ggatcctggg tgctaccgct  1500
tataaacata ttatttgggt tggtccagct tcagctggtt tagcttttgg tttcggtatg  1560
gtgttgattt attattcatt gaataattac attattgatt gctacgtcca atacgcatcc  1620
agtgctctgg ctacaaaggt tttcttaaga tccgccggtg gtgctgccct cccttgttt   1680
accattcaaa tgtaccacaa attgaatttg cactgggggt cttggttgtt ggctttcatc  1740
tccactgcta tgattgcttt accttttgca ttttcttact ggggtaaggg cttgagacat  1800
aagttgtcca agaaggacta ttccatcgac agtgttgaga tgtaa                  1845

SEQ ID NO: 12
MNRQESINSF NSDETSSLSD VESQQPQQYI PSESGSKSNM APNQLKLTRT ETVKSLQDMG    60
VSSKAPVPDV NAPQSSKNKI FPEEYTLETP TGLVPVATLH SIGRTSTAIS RTRTRQIDGA   120
SSPSSNEDAL ESDNNEKGKE GDSSGANDEA PDLDPEIEFV TFVTGDPENP HNWPAWIRWS   180
YTVLLSILVI CVAYGSACIS GGLGTVEKKY HVGMEAAILS VSLMVIGFSL GPLIWSPVSD   240
LYGRRVAYFV SMGLYVIFNI PCALAPNLGS LLACRFLCGV WSSSGLCLVG GSIADMFPSE   300
TRGKAIAFFA FAPYVGPVVG PLVNGFISVS TGRMDLIFWV NMAFAGVMWI ISSAIPETYA   360
PVILKRKAAR LRKETGNPKI MTEQEAQGVS MGEMMRACLL RPLYFSVTEP VLVATCFYVC   420
LIYSLLYAFF FAFPVIFGEL YGYKDNLVGL MFIPIVIGAL WALATTFYCE NKYLQIVKQR   480
KPTPEDRLLG AKIGAPFAAI ALWILGATAY KHIIWVGPAS AGLAFGFGMV LIYYSLNNYI   540
IDCYVQYASS ALATKVFLRS AGGAAFPLFT IQMYHKLNLH WGSWLLAFIS TAMIALPFAF   600
SYWGKGLRHK LSKKDYSIDS IE                                            622

SEQ ID NO: 13
atgactgatc gtaaaaccaa cttgccagaa gaaccgattt tcgaagaggc agaagatgat    60
ggctgccctt cgatagaaaa ttcttcacat ctgtcagtac ctacagtgga ggaaaacaag   120
gacttttccg agtataatgg ggaagaggca gaggaagttg ttgttccaga aaagcctgct   180
tcagcctatg ctactgtttc tatcatgtgt ttatgtatgg ctttcggtgg atttatgtcc   240
ggttgggaca caggtacgat ttctggtttc gtcaatcaga ctgattttttt aagaagattt   300
ggtaattata gccattccaa gaacacttac tacttatcta atgtgagaac tgggttgatt   360
gtgtccatct tcaatgtggg aagcgccatt ggctgtcttt tcttgtctaa attgggtgat   420
atttacggcc gctgcatggg tttgattata gttattgtcg tttatatggt tggtattgtc   480
attcaaattg ccctctataga taagtggtat cagtatttta ttggaagaat tatcgctggt   540
ataggtgctg gttccattag tgttcttgcc ccgatgctta tttcggaaac tgcgccaaag   600
catatcagag gtacgttgct agcttgttgg caattgatgg tgactttcgc aatttttcttg   660
ggttattgta ccaattatgg taccaagact tactcgaatt ctgtccagtg gcgtgttccg   720
cttggtctat gttttgcatg ggctattatt atgattggtg gtatgacgtt tgttccggaa   780
tctcctcggt ttttggtgca aggtaagg attgagcaag ctaaagcttc ttttgccaag   840
tcgaacaagc ttagtgttga cgatcctgct gtggttgcag agattgatct tcttgttgct   900
ggtgtggagg cagaagaagc aatgggaact gcttcatgga aggaattatt tcgagaaag    960
actaaagttt ttcaacgttt aacgatgaca gtcatgatta actctctgca gcaactaacc  1020
ggtgacaact atttctctcta ctacggtact actatctcca aatctgtcgg tatgaatgac  1080
tctttttgaga cttcaattgt cttgggtatt gtgaattttg cttcttgctt cttttcactt  1140
tattctgttg ataagttggg ccgtcgtaga tgtcttttac ttggagcagc caccatgacg  1200
gcgtgcatgg ttatttacgc ctccgttggc gtcacaagac tatatccgaa cggtaaaagt  1260
gaaccatcat ctaaaggtgc tggtaattat acgattttgt tcacgtgttt ttacatttt   1320
tgcttttcct gcacctgggg acctgtatgt tatgtgatta tttctgaaac atttccatta  1380
agggtgagat ccaagtgtat gtccgttgca acagcggcca acttattgtg ggggttccta  1440
atcgggtttt tcactccttt tattacttcg gcaattaatt tctactacgg ttacgttttc  1500
atgggttgct tagcgttttc atattttttac gtctttttct ttgttccaga aacaaaaggt  1560
ctaactttag aagaagttga tgagatgtgg atggacggtg tattaccttg gaaatctgaa  1620
tcctgggtac cagcttctag aagggatggt gattatgata cgaaaaatt acagcatgac  1680
gagaaaccct tctacaaaag aatgttttag                                   1710

SEQ ID NO: 14
MTDRKTNLPE EPIFEEAEDD GCPSIENSSH LSVPTVEENK DFSEYNGEEA EEVVVPEKPA    60
SAYATVSIMC LCMAFGGFMS GWDTGTISGF VNQTDFLRRF GNYSHSKNTY YLSNVRTGLI   120
VSIFNVGSAI GCLFLSKLGD IYGRCMGLII VIVVYMVGIV IQIASIDKWY QYFIGRIIAG   180
IGAGSISVLA PMLISETAPK HIRGTLLACW QLMVTFAIFL GYCTNYGTKT YSNSVQWRVP   240
LGLCFAWAII MIGGMTFVPE SPRFLVQVGK IEQAKASFAK SNKLSVDDPA VVAEIDLLVA   300
GVEAEEAMGT ASWKELFSRK TKVFQRLTMT VMINSLQQLT GDNYFFYYGT TIFKSVGMND   360
SFETSIVLGI VNFASCFFSL YSVDKLGRRR CLLLGAATMT ACMVIYASVG VTRLYPNGKS   420
EPSSKGAGNC TIVFTCFYIF CFSCTWGPVC YVIISETFPL RVRSKCMSVA TAANLLWGFL   480
IGFFTPFITS AINFYYGYVF MGCLAFSYFY VFFFVPETKG LTLEEVDEMW MDGVLPWKSE   540
SWVPASRRDG DYDNEKLQHD EKPFYKRMF                                     569

SEQ ID NO: 15
atgaattcaa ctccagattt aatatctcca caaaagtcaa gtgagaattc gaatgctgac    60
ctgccttcga atagctctca ggtaatgaac atgcctgaag aaaaaggtgt tcaagatgat   120
ttccaagctg aggccgacca agtacttacc aacccaaata caggtaaagg tgcatatgtc   180
actgtgtcta tctgttgtgt tatggttgcc ttcggtggtt tcgttttcgg ttgggatact   240
ggtaccattt ctggtttcgt cgcccaaact gatttcttga gaagattcgg tatgaagcat   300
aaagatggta gttattattt gtctaaggtt agaactggtt taattgtctc cattttcaac   360
attggttgtg ccattggtgg tattattttg ctaaattgg gtgatatgta cggtcgtaaa   420
atgggtttga ttgtcgttgt tgttatctac atcatcgtta ttattattca aattgcataa   480
atcaacaaat ggtaccaata tttcatcggt agaattattt ccggtttggg tgttggtggt   540
attgccgttt tatctcctat gttgattgct gaagtcgctc ctaaggaaat gagaggtact   600
ttagtctcct gttaccaact gatgattacc ttgggtattt tcttgggtta ctgtaccaac   660
ttcggtacta gaactactc caactctgtg caatggagag ttccattagg tttgtgtttt   720
gcctgggctt tgtttatgat cggtggtatg actttcgttc agaatccccc acgttatttg   780
```

TABLE 3-continued

Sequences disclosed herein.

```
gttgaagctg gtcaaattga cgaagcaaga gcatctcttt ccaaagttaa caaggttgcc    840
ccagaccatc cattcattca acaagagttg gaagttattg aagctagtgt tgaagaagct    900
agagctgctg gttcagcatc atggggtgag ttgttcactg gtaagccggc catgtttaag    960
cgtactatga tgggtatcat gatccaatct ctacaacaat tgactggtga taactatttc   1020
ttctactatg gtactaccgt ttttaacgct gttggtatga gtgattcttt cgaaacttct   1080
attgttttcg gtgtcgtcaa cttcttctct acttgttgtt ctttgtacac tgtcgatcgt   1140
tttggacgtc gtaactgttt gttatatggt gccattggta tggtctgctg ttatgtagtt   1200
tacgcttctg ttggtgtcac cagactatgg ccaaatggtg aaggtaatgg ttcatccaag   1260
ggtgctggta actgtatgat tgtctttgcc tgtttctata ttttctgttt tgctaccact   1320
tgggctccaa ttgcttatgt tgttatttct gaaactttcc cattgagagt caagtctaag   1380
gctatgtcta ttgctacagc tgctaattgg ttgtgggtc tcttgattgg tttcttcact   1440
ccatttatta ctggtgctat taacttctac tacggttacg ttttcatggg ctgtatggtt   1500
ttcgcctact tctacgtttt cttctttgtg ccagaaacta aggggtttgac tttggaagaa   1560
gtcaatgata tgtacgctga aggtgttcta ccatggaagt ctgcttcatg ggttccaaca   1620
tctcaaagag gtgctaacta cgatgctgat gcattgatgc atgatgacca gccattctac   1680
aagaaaatgt tcggcaagaa ataa                                          1704

SEQ ID NO: 16
MNSTPDLISP QKSSENSNAD LPSNSSQVMN MPEEKGVQDD FQAEADQVLT NPNTGKGAYV     60
TVSICCVMVA FGGFVFGWDT GTISGFVAQT DFLRRFGMKH KDGSYYLSKV RTGLIVSIFN    120
IGCAIGGIIL AKLGDMYGRK MGLIVVVIY IIGIIIQIAS INKWYQYFIG RIISGLGVGG    180
IAVLSPMLIS EVAPKEMRGT LVSCYQLMIT LGIFLGYCTN FGTKNYSNSV QWRVPLGLCF    240
AWALFMIGGM TFVPESPRYL VEAGQIDEAR ASLSKVNKVA PDHPFIQQEL EVIEASVEEA    300
RAAGSASWGE LFTGKPAMFK RTMMGIMIQS LQQLTGDNYF FYYGTTVFNA VGMSDSFETS    360
IVFGVVNFFS TCCSLYTVDR FGRRNCLLYG AIGMVCCYVV YASVGVTRLW PNGEGNGSSK    420
GAGNCMIVFA CFYIFCFATT WAPIAYVVIS ETFPLRVKSK AMSIATAANW LWGFLIGFFT    480
PPITGAINFY YGYVFMGCMV FAYFYVFFFV PETKGLTLEE VNDMYAEGVL PWKSASWVPT    540
SQRGANYDAD ALMHDDQPFY KKMFGKK                                        567

SEQ ID NO: 17
atgatttgga ttatgactat ggcccgtaga atgaacggcg tctacgctgc ttttatgttg     60
gttgctttca tgatgggtgt tgccggtgct ttgcaagctc caactttgtc tttattttg    120
tccagagaag tcggtgctca accattctgg atcggcttgt tctacaccgt caacgctatt    180
gctggtattg gcgtttcttt gtggttagct aagaggtctg actctcaggg tgataggaga    240
aagctgatta tcttctgttg cttgatggct attggcaacg ctctattgtt cgccttcaac    300
agacattacc tgactctgat cacttgtggc gtcttgttgg cttctttggc taatactgct    360
atgccacaac tattcgcttt ggctcgtgaa tacgctgaca attctgctcg cgaagtggtt    420
atgttctcat ctgttatgag ggctcaattg tcttttggcat gggttattgg tccaccattg    480
gcattcatgc tggctttgaa ctacggcttc accgttatgt tttccattgc tgcaggcatc    540
ttcacctgt ctctagttct gatcgccttt atgttaccct ccgtcgctag agttgaattg    600
ccatctgaaa atgctttgtc tatgcaaggt ggttggcaag actccaacgt cagaatgttg    660
ttcgttgctt ctacctgat gtggacctgc aacaccatgt acatcatcga tatgcccttg    720
tggatttcct ctgaattggg tttgccagac aagttagctg gttttttgat gggtactgct    780
gctggtttgg agattccagc tatgatcttg gccggttact acgttaaacg ctatgtgtaag    840
aggagaatga tggttatcgc tgttgctgcc ggcgttttgt tttacactgt cctgatcttg    900
ttccattcta ggctggctct gatgacttg caattgttta atgctgtctt catcggtatc    960
gtcgccggta taggcatgtt gtggtttcag gatttgatgc caggtagagc tggtgctgct   1020
accactttgt ttaccaattc tatttctact ggcgtcattt tggctggtgt cattcaaggt   1080
gccatcgctc aatcctgggg tcacttcgct gtttattggg tcattgctgt tatttccgtt   1140
attgccttgt tcctgactgc taaagtcaag gatgtttaa                         1179

SEQ ID NO: 18
MIWIMTMARR MNGVYAAFML VAFMMGVAGA LQAPTLSLFL SREVGAQPFW IGLFYTVNAI     60
AGIGVSLWLA KRSDSQGDRR KLIIFCCLMA IGNALLFAFN RHYLTLITCG VLLASLANTA    120
MPQLFALARE YADNSAREVV MFSSVMRAQL SLAWVIGPPL AFMLALNYGF TVMFSIAAGI    180
FTLSLVLIAF MLPSVARVEL PSENALSMQG GWQDSNVRML FVASTLMWTC NTMYIIDMPL    240
WISSELGLPD KLAGFLMGTA AGLEIPAMIL AGYYVKRYGK RRMMVIAVAA GVLFYTGLIL    300
FHSRLALMTL QLFNAVFIGI VAGIGMLWFQ DLMPGRAGAA TTLFTNSIST GVILAGVIQG    360
AIAQSWGHFA VYWVIAVISV IALFLTAKVK DV                                 392

SEQ ID NO: 19
agtccagtta cgctggagtc aagcaagctt aaaatgcata attccccagc tgtcacttct     60
gccaagtctt tcgatttgac tagcatggca ttcttgattg ttgcttttttt gaccggcatc    120
gctggtgcct tgcaaacccc aactttgtcc attttcttga ctgatgaagt tcacgctaga    180
ccagctatgg tgggcttttt ctttactggt tccgccgtta ttggtatcct agtctctcaa    240
ttttttggccg gtaggtctga caaaaggggg gatagaaaat ccctgattgt cttctgctgt    300
ttgttgggtg ttttggcctg taccttgttc gcttggaaca ggaactattt tgtcctgttg    360
ttcgttggcg tttttctgtc ttccttcggt tctaccgcta tccccaaat gtttgctttg    420
gctagagaac atgccagcaa aactgtagga gaggctgtta tgttttcttc tttcttgagg    480
gctcaagttt ctctggcctg ggttattggt ccacctttgg cttatgctct ggctatgggt    540
ttttcctta ccgttatgta tctgtctgct gctgtcgcct ttatcgtttg tggtgtcatg    600
gtctggttgt ttttgccctc tatgcagaaa gaattgccat ggctactgg tactgttgaa    660
agacaagaa ggaataggag agacaccttg ttgctgttca tcatttgcac tctgatgtgg    720
ggttccaatt ccctgtacat cattaacatg ccactgttca tcatcaatga gttgcatctg    780
cccgaaaaat tggctggtgt tatgatgggg actgctgccg gctggaaat tccaaccatg    840
ttgattgctg gctattttgc taagagattg ggcaagaggt tttgatgag ggttgctgca    900
gttggtggtg tttgtttta cgctggtatg ttgatggctc attctccagt catccttgta    960
ggtttgcagt tgctgaacgc tatcttcatc ggtatcttgg gcggtattgg gatgttgtac   1020
```

TABLE 3-continued

Sequences disclosed herein.

```
tttcaggatt tgatgccagg tcaagctggt tctgctacta ctttgtacac taatacttcc   1080
agagttggtt ggattatcgc cggttctgtt gctggcattg tcgctgaaat ctggaattac   1140
catgccgtct tttggttcgc tatggtcatg atcatcgcta ccctgttctg cttgttgagg   1200
attaaagacg tttaaccgcg gcatcactga ccatttaaat catac                   1245

SEQ ID NO: 20
MHNSPAVTSA KSFDLTSMAF LIVAFLTGIA GALQTPTLSI FLTDEVHARP AMVGFFFTGS    60
AVIGILVSQF LAGRSDKRGD RKSLIVFCCL LGVLACTLFA WNRNYFVLLF VGVFLSSFGS   120
TANPQMFALA REHADKTGRE AVMFSSFLRA QVSLAWVIGP PLAYALAMGF SFTVMYLSAA   180
VAFIVCGVMV WLFLPSMQKE LPLATGTVEA PRRNRRDTLL LFVICTLMWG SNSLYIINMP   240
LFIINELHLP EKLAGVMMGT AAGLEIPTML IAGYFAKRLG KRFLMRVAAV GGVCFYAGML   300
MAHSPVILLG LQLLNAIFIG ILGGIGMLYF QDLMPGQAGS ATTLYTNTSR VGWIIAGSVA   360
GIVAEIWNYH AVFWFAMVMI IATLFCLLRI KDV                               393

SEQ ID NO: 21
agtccagtta cgctggagtc aagcaagctt aaaatgcaaa agactgctac tactccatct    60
aaaattctgg acttgacagc tgctgctttt ttgttggttg ccttcctgac tggtattgcc   120
ggtgctctac aaactccaac tttgtccatt ttcttggctg acgaattgaa agctcgccca   180
attatggtcg gtttcttttt cactggttcc gccatcatgg ggtctgggt ttctcaattt    240
ttggctaggc attctgataa gcagggcgac aggaagttgt tgattttgtt gtgttgtttg   300
ttcggcgttt tggcctgtac cttgtttgcc tggaacagga actacttcat tttgctgtcc   360
actggtgtct tgttgtcttc ttttgcttcc accgccaatc cacaaatgtt tgctttggca   420
agagaacacg ctgatagaac cggtagagag actgtcatgt tctctacttt tctgagagcg   480
caaatctctt tggcttgggt cattggtcca ccattggctt acgaattggc tatgggcttt   540
tctttcaagg tcatgtattt gactgctgcc attgctttcg ttgtctgtgg cttgattgtc   600
tggttgttct gccatccat ccaaaggaat atccccgttg ttactcagcc agttgaaatt    660
ttgccctcta ttcacagaaa gcgcatacct agattgctgt tcgtcgtttg ttccatgatg   720
tgggccgcca acaacctgta catgattaac atgcccctgt tcattatcga tgaattgcac   780
ttgactgata aattggctgg cgaaatgatc ggtatcgctg ccggtctgga aattccaatg   840
atgctgattg ctggttacta catgaagaga attggtaaga ggctattgat gctcatcgcc   900
atcgtctctg gtatgtgctt ctacgcttct gttttgatgg ccactactcc tgccgttgag   960
tggaattgc aaaattctgaa tgccatcttc ttgggtatct tgtgcggtat tggtatgctg   1020
tactttcagg acctgatgcc cgaaaaaatc ggttctgcta ccactttgta tgctaatact   1080
tccagggtcg gttggattat cgctggttct gttgatggta tcatggtcga gatttggtcc   1140
taccatgctt tgttttggtt ggccatcggt atgctcggta ttgctatgat ctgcctgttg   1200
tttatcaagg acatctaacc gcggcatcac tgaccattta aatcatac                1248

SEQ ID NO: 22
MQKTATTPSK ILDLTAAAFL LVAFLTGIAG ALQTPTLSIF LADELKARPI MVGFFFTGSA    60
IMGILVSQFL ARHSDKQGDR KLLILLCCLF GVLACTLFAW NRNYFILLST GVLLSSFAST   120
ANPQMFALAR EHADRTGRET VMFSTFLRAQ ISLAWVIGPP LAYELAMGFS FKVMYLTAAI   180
APFVVCGLIVW LFLPSIQRNI PVVTQPVEIL PSIHRKRDTR LLFVVCSMMW AANNLYMINM   240
PLFIIDELHL TDKLAGEMIG IAAGLEIPMM LIAGYYMKRI GKRLLMLIAI VSGMCFYASV   300
LMATTPAVEL ELQILNAIFL GILCGIGMLY FQDLMPEKIG SATTLYANTS RVGWIIAGSV   360
DGIMVEIWSY HALFWLAIGM LGIAMICLLF IKDI                              394

SEQ ID NO: 23
atggtcttta ttaaggtcca tcaattggct tttttgttcg gtctgctggg taatatcgtc    60
tccttcggtg ttttcttgtc tcccgtccca acctttacg gtatctataa gaagaaatcc    120
tccaagggct tccaatccat tccatacatt tgtgctttgg cttctgctac cctgttgttg   180
ttctacggca tcatgaagac ccatgcctac ctgattatct ctatcaatac cttcggttgc   240
ttcatcgaga tcagctacct gttcctatac atcatctatg cccccaagaga agctaggatc   300
ttcaccttga agctgatttt gatttgtaac attggcggct ggggtctgtt gattctactg   360
gttgatctat tgatccccaa gcaacacagg gtttctactg ttggttgggt ttgtgctgct   420
tattctttgg ctgttttttgc ttctccactg tctgtcatga gaaaggtcat tagaaccaag   480
tccgtcgaat acatgccatt gttgctgtct ttgtctctga ctctgaatgc tgtcatgtgg   540
ttcttctacg gttttgttgat cgaggataag ttcattgcca tgcccaatat cttgggtttt   600
ctgtttggta ttgcccagat gatcctgtac atgatgtacc acgactctaa gaagactgat   660
ctgcccaaat tgacctctac cgaaaatcaa cccactaaca tcactaatct gaacgaagtc   720
gctattgttg ccgtcgagtt gtctgatgct agagctgaaa atgttgaagg ttctgttagg   780
ccaatgactc caaattcatc tactactgct taa                               813

SEQ ID NO: 24
MVFIKVHQLA FLFGLLGNIV SFGVFLSPVP TFYGIYKKKS SKGFQSIPYI CALASATLLL    60
FYGIMKTHAY LIISINTFGC FIEISYLFLY IIYAPREARI FTLKLILICN IGGLGLLILL   120
VDLLIPKQHR VSTVGWVCAA YSLAVFASPL SVMRKVIRTK SVEYMPLLLS LSLTLNAVMW   180
FFYGLLIEDK FIAMPNILGF LFGIAQMILY MMYHDSKKTD LPKLTSTENQ PTNITNLNEV   240
AIVAVELSDA RAENVEGSVR PMTPNSSTTA                                   270

SEQ ID NO: 25
aagcttaaaa tggcccaatt gagagccgat gatttgtctt tcatttttcgg tttgttgggc    60
aacatcgttt ccttcatggt tttttttggct ccagttccaa ccttctacaa aatctacaag   120
aggaagtcct ccgaaggtta tcaagctatt ccatatatgg ttgctttgtt tctctgctggc   180
ttgttgtttgt attatgccta cttgagaaag aacgcctacc tgatcgtttc tattaacggt   240
tttggttgcg ctatcgaatt gacctacatt tccttgcttt tgttctacgc cccaagaaag   300
tctaagattt tactggttg gctgatgttg tggaattgg gtgctttggg tatggttatg    360
ccaattactt atttgttggc cgaaggttcc catagagtta tgatagttgg ttggatttgc   420
gctgctatta acgttgctgt ttttgctgct ccattgtcca ttatgagaca agttattaag   480
```

TABLE 3-continued

Sequences disclosed herein.

```
accaagtccg tcgagtttat gccattcact ttgtctttgt tcttgacctt gtgtgctact    540
atgtggtttt tctacggttt cttcaagaag gacttctaca ttgcctttcc aaacattttg    600
ggtttcttgt tcggtatcgt ccagatgttg ttgtacttcg tttacaagga ctccaagaga    660
atcgatgacg aaaaatctga tccagttaga gaagccacca agtctaaaga aggtgttgaa    720
atcatcatca acatcgagga tgataactct gataacgcct tgcaatctat ggaaaaggat    780
ttctccagat tgaggacctc taagtaaccg cggctcgagt catgtaa                  827
```

SEQ ID NO: 26
```
MAQLRADDLS FIFGLLGNIV SFMVFLAPVP TFYKIYKRKS SEGYQAIPYM VALFSAGLLL     60
YYAYLRKNAY LIVSINGFGC AIELTYISLF LFYAPRKSKI FTGWLMLLEL GALGMVMPIT    120
YLLAEGSHRV MIVGWICAAI NVAVFAAPLS IMRQVIKTKS VEFMPFTLSL FLTLCATMWF    180
FYGFFKKDFY IAFPNILGFL FGIVQMLLYF VYKDSKRIDD EKSDPVREAT KSKEGVEIII    240
NIEDDNSDNA LQSMEKDFSR LRTSK                                         265
```

SEQ ID NO: 27
```
atgggtggtt tgtctatgga acatccttgg gctttcgctt ttggtctgct aggtaacgtc     60
atttcttttt cctctttgtt ggccccatt ccaaccttt acaggatttt aagtccaag      120
tccaccgaag gctttcaatc cgtcccatac gtcgttgcct tattctctgc tatgttgtgg    180
atcttttacg ccttggttaa gactggtgaa ggtctgttga tttccattaa tgccgccggt    240
tgtgtcattg aaactgtcta catcgtcatg tacttggttt acgctcccag aaaggccaaa    300
atctttactg ctaagatcgt cgtcttgttg aacatcaccg gttcggtttt gatcttcctg    360
ttgactttgt ttgctttcca cggtgaaact agagtcgttt ctttgggttg gatttgtgtc    420
ggtttctccg tctgtgtttt cgttgctcca ttgtctatta ttggcagagt catcaagact    480
aagtccgtcg agtatatgcc attccacctt g tccttgacct tgactctgtc cgccattgtt    540
tggtttttgt atggcttgtt gatcaaagac aagtatgttg ccttgcccaa tattttgggc    600
ttcaccttcg gcgtcatcca aatggttctg tacgtcttct acatgaataa accccagtc     660
gcttctgaag ttaaggaagg taaggaagca tggaaggctc cagctgaaga tcatgttgtt    720
gttatcaacg tcggtaagac tgataaaggt tcttgtgccg aagttagacc agttactgaa    780
atggcttccg ctgttgatgt tcctagaaga tgtgctgctg aagctgctgc agctccaggt    840
gtcgattttg ctaggtctgt cgatgttgtt taa                                873
```

SEQ ID NO: 28
```
MGGLSMEHPW AFAFGLLGNV ISFSSLLAPI PTFYRIFKSK STEGFQSVPY VVALFSAMLW     60
IFYALVKTGE GLLISINAAG CVIETVYIVM YLVYAPRKAK IFTAKIVVLL NITGFGLIFL    120
LTLFAFHGET RVVSLGWICV GFSVCVFVAP LSIIGRVIKT KSVEYMPFTL SLTLTLSAIV    180
WFLYGLLIKD KYVALPNILG FTFGVIQMVL YVFYMNKTPV ASEVKEGKEA WKAPAEDHVV    240
VINVGKTDKG SCAEVRPVTE MASAVDVPRR CAAEAAAAPG VDFARSVDVV               290
```

SEQ ID NO: 29
```
atggctccaa aaatttcaat atccttaaac ccaccgtaca acggggagtt ttatagctct     60
aatgatcaaa tgtcagggat agttagtctt cagttaacaa agcgctatc tataaggaaa    120
atttccgtca ttctaaaagg attctcagag accttaacaa aaattgatca agagtacatg    180
tttcaacaga atggcatgat gatgccgggc aagacaaca atcctttca tacattaatg    240
aaattcgaac agagagtttt ccctccagat aatgtatgga atgctcttga tggctcctcc    300
aagccgttca aagttaaacc aggttcatat aattatagcT ttcaatttga caagtttccc    360
agaaagcctg aatgtctgaa aaatcatacg gcaaagacag tagcgtttgt gacaagaagt    420
aatgcccgac tcccacctac gttcaatagt cattggcaag aatttaataa atcgataat    480
ctggatttgt attttactc ttttggaaaa gttatatata tggtgcaagt tcaattagag    540
ctagggaaat cttcatcttg gttaagcca ttccataaac tgataaggga aatcgagacg    600
ttcgaattta tacctgagcc aaaagatctt attataggaag ctgatgaaga tgacaatgaa    660
gaacttaatg ccttcagtaa caatagtaga ggaaatagta tggtcaccaa caatgaattt    720
ttcaatagtt caaatttaaa ggtgccatca aaggacgtca aagtcgttaa tggagtcgga    780
tatataaaaa gtgacaggaa cttttctcaa gctaattcta tattgataga aaacggcgac    840
attagatcga gaccggtatc atcagtcaca tcaacaagac aatctactcg cctagtaaat    900
ggtatgaaag ttttcccatc tacttataaa atggggttgc ctgatgggga aagcaattg    960
agaatagagg ttagaagtcg agatttgaag caaatataca ggaaagacta cttgtttagg   1020
tctggcagcc aaaattttga caaggtctat gtagtcatgg aggggaatat agcaagtttg   1080
agcaaaatgc aaattacccc acttaaacta caactgaact tgctagagac tacaacatat   1140
ttatctcagg gaatagcgaa cggcaattac tcttctttga agctaatcga gattgatttg   1200
aatcagctca aatccaataa acctcttttg gacttaaacg aaatacgaaa aatttttgat   1260
ggttctatgt ttgaatgtga attacggtta aaggatcacc ccattttaag aaagttggta   1320
tttaatgaag aagactatag acatcgcggg aataggttgt atagtttcaa gacatgcacg   1380
ataaaaagaa cattcagttt acagctactg atagaatggg gaatcaatgg aattaggaag   1440
caatctgaag taaacattga tcctgttcag atctttgtc aagttagaga gcacgttgaa   1500
gctgaagctc tgcccagata tgtaccgcca ccgacatata ctgaaatggc gagttaa      1557
```

SEQ ID NO: 30
```
MAPKISISLN PPYNGEFYSS NDQMSGIVSL QLTKALSIRK ISVILKGFSE TLTKIDQEYM     60
FQQNGMMMPG QDNKSFHTLM KFEQRVFPPD NVWNALDGSS KPFKVKPGSY NYSFQFDKFP    120
RKPECLKNHT AKTVAFVTRS NARLPPTFNS HWQEFNKIDN LDLYFYSFGK VIYMVQVQLE    180
LGKSSSWFKP FHKLIREIET FEFIPEPKDL IIEPDEDDNE ELNAFSNNSR GNSMVTNNEF    240
FNSSNLKVPS KDVKVVNGVG YIKSDRNFSQ ANSILIENGD IRSRPVSSVT STRQSTRLVN    300
GMKVFPSTYK MGLPDESNM RIEVRSRDLK QIYRKDYLFR SGSQNFDKVY VVMEGNIASL    360
SKMQITPLKL QLNLLETTTY LSQGIANGNY SSLKLIEIDL NQLKSNKPLL DLNEIRENFD    420
GSMFECELRL KDHPILRKLV FNEEDYRHRG NRLYSFKTCT IKRTFSLQLL IEWGINGIRK    480
QSEVNIDPVQ IFCQVREHVE AEALPRYVPP PTYTEMAS                           518
```

TABLE 3-continued

Sequences disclosed herein.

```
SEQ ID NO: 31
atggcatttt cacgtcttac atctactcat cagtccaatc ataacggcta cagtaatagc    60
aacaaaaaag gacaaagtct tccactaacc ctttctattg atgtagaatc accgccatgt   120
gttctttatg ggtctgctat ggaatcctca ggtgctgtgc taagtggact ttttactgtg   180
acggttgtcg atccctacag tagtgctgaa gataaatctt aaagaatac agaatctaat    240
gtgtcgacta cttctaaaag cctaaaaaga aagagtacat ttggttctgc actttcatct   300
agattgtcca gcttgtcagc gtcgacgtca aatatctctc cttcaacatc ttctacatcc   360
atatcgcatt ctcccacgcc tgctaattta agaataatgg ctggttatac caagatcacc   420
attacgtcgg taacactaag tttggtacag aagatccatt ccataaacc ctttgtgcct    480
aatatttcct caatgcaaac ctgtatgaac tgtaaaacaa agattacaaa catgaaaagc   540
tgggaaattc agagtaatac ccaggatctt tctgttggaa gccactctta cccatttcc    600
tatcttatac cggggtctgt cccatgttct tcatcgctag gtgctacggc tgaaacccag   660
gtcaaatacg aacttatcgc tgttgtgacg tatatagatc ctcatagaaa ttcctttctct  720
tccggtcatt ctactcccag gaaagaagga agctcttcta agaagcggtt gttgcaacta   780
gcgatgccca tcgccgtgac tcgaagtata ccgcgcgggc ctgataagaa ttctctaaga   840
gtatttcctc ctacagagtt aactgctgct gctgttcttc ctaatgttgt atatcctaaa   900
tctacttttc ctttggagat gaaattagac ggtgtttctt cggggatag gagatggcga    960
atgcgtaaat tgagttggag aattgaagaa actacaagag ttaaagcaca tgcttgtcca   1020
gtgcacaagc atgaattgag gcagttagaa gagcaggtta aaataaaaga gtcagaaaaa   1080
agtaaaaagc cacgcagtca tattaagcgt tatggtgaac taggcccaca aatccgggtt   1140
gcagtaaact ctttagaaaa tatgccgtcg caaaggcttc caggcgagcc cggtcgtgaa   1200
caagcaccta attcttcggg tccagcgtca actggtactt gtgggacttga tgatgaaaat   1260
cctgttaatg aagatgagga agaccaaccc ggtagcgaat tcatccatcc cagtgacgc    1320
gctttgcgtc aggagttact aatgcagcaa caacgcgcaa gacaacaaca acttcaacaa   1380
gagctaaaaa acaacagtag tttatttacg gaagaggttc ggataatatc taagggagaa   1440
atgaagagtg gatggaaaac cgattttgac aataatgaaa agattgagct agttacagaa   1500
atagattgta tgggacttaa ttcaggcgtc tctaatccgg taatgcatgc atcgacacta   1560
caaactcctt ccacgggcaa taagaagccc agcatcaatg tggcttgcga tatacaggat   1620
ccaaatttag gtttgtatgt aagccacatc ttggcagtgg aaatagttgt tgcagaagaa   1680
acattgcaat atgccaatgg gcaacctata cggaaaccaa actccaaaaa caagaaagaa   1740
actaataaca atacgatgaa tgttcataat cctgatcaac gcttagctga attatctcca   1800
attttttgcaa atagaaatac accgaaagta cggcgcatgg ggcctgaaga tataacaccg   1860
gtgaatagta ataagtccaa ccatagtact aataaggaga aggcatcaa cggtgctagt   1920
aactctaata tagtgagtgt tcccactggt gcagcacgtg ttttaagaat gcaattcaga   1980
ttaacagtca ctgaaagatc tggacttgga atctcctggg acgaagaagt tcctcccatt   2040
taccaagatg tcgagttgct ctcgccacca tgttacgagc tctctataaa taatggaatc   2100
aaaaataaac tttattcaac aatgagtact cctgttagat caggaggatga ttttgtgggc   2160
ggcagcgatg aagatattgg gaactatgag agccaagggc tcgaacctgg tcctaacgta   2220
caggaagtaa cgatcacaca aaataaatta acgatacgac caaccgcaca tcactaccag   2280
cctgcttcct cttcgcaaag atcccttacc acagtacagt caccaccact ggaaagtgtt   2340
gttagtgtcc agggtagtgt acctttcgt ggacatgtgt tgacaccaca tagcacaaga   2400
gatatcagaa tacaaaactt ttccgatttt ctagattcca atagaataac ccagtag     2457

SEQ ID NO: 32
MAFSRLTSTH QSNHNGYSNS NKKGQSLPLT LSIDVESPPC VLYGSAMESS GAVLSGLFTV    60
TVVDPYSSAE DKSLKNTESN VSTTSKSLKR KSTFGSALSS RLSSLSASTS NISPSTSSTS   120
ISHSPTPANL RIMAGYTKIT ITSVTLSLVQ KIHFHKPFVP NISSMQTCMN CKTKITNMKS   180
WEIQSNTQDL SVGSHSYPFS YLIPGSVPCS SSLGATAETQ VKYELIAVVT YIDPHRNSFS   240
SGHSTPRKEG SSSKKRLLQL AMPIAVTRSI PRGPDKNSLR VFPPTELTAA AVLPNVVYPK   300
STFPLEMKLD GVSSGDRRWR MRKLSWRIEE TTRVKAHACP VHKHELRQLE EQVKIKESEK   360
SKKPRSHIKR YGELGPQIRV AVNSLENMPS QRLPGEPGRE QAPNSSGPAS TGNVGLDDEN   420
PVNEDEEDQP GSEFIHPSDD ALRQELLMQQ QRARQQQLQQ ELKNNSSLFT EEVRIISKGE   480
MKSGWKTDFD NNGKIELVTE IDCMGLNSGV SNPVMHASTL QTPSTGNKKP SINVACDIQD   540
PNLGLYVSHI LAVEIVVAEE TLQYANGQPI RKPNSKNKKE TNNNTMNVHN PDQRLAELSP   600
IFANRNTPKV RRMGPEDITP VNSNKSNHST NKEKASNGAS NSNIVSVPTG AARVLRMQFR   660
LTVTERSGLG ISWDEEVPPI YQDVELLSPP CYELSINNGI KNKLYSTMST PVRSEDDFVG   720
GSDEDIGNYE SQGLEPGPNV QEVTITQNKL TIPPTAHHYQ PASSSQRSLT TVQSPPLESV   780
VSVQGSVPFR GHVLTPHSTR DIRIQNFSDF LDSNRITQ                           818

SEQ ID NO: 33
atgccgttta acatcaag accggtggcg aaaaattcat cccactcttt atcagaaaca     60
gatttaaacc agtctaaagg acagccgttt caaccctctc ccaccaagaa attagggtcc   120
atgcaacaac gaagaagatc ctccaccatt aggcacgcgc atcatctttt acttggtggc   180
gctaatgttc actcacctgc cgtcttgaac aacacaacga aaggcggcaa taataacgcg   240
aacatcagaa gcagcaatac agacgcccaa ctccttggca aaaaacagaa caaacagccg   300
ccgcaaacg caaggcgaca cagtaccact gccatacagg gctctatcag cgatagtgct   360
actacgactc cgagatcctc gacttccgac caaccgtc gcacttcggg aagattgtcg     420
gtagaccaag agcccagaat ctctggggga cgctattcaa cagttgagga ggatagcaca   480
gtactagatt ttgatgatga ccataactca tcagctgtag tgtcaagcga tttatcatca   540
acttctctaa caaggttggc aaactcgaaa agtttaacg agcaattttct catagaaatt   600
ttaaccgcta gaggtctcct gggcccaaaa accgttctat ccaatgagta cttgaagatt   660
tctatttcta caagcggtga aagcgttttc ttaccaacga tatcctcgaa tgacgatgag   720
tacctgtcca gactaaacg actcaatgat ggtacgaacg atgctgaggc ggatttttt    780
atggatggta tagaccagca agaagtaac actccatctc tcgctacaac ggcagcggct   840
accgaaagtg gtgcagcat aaatgaaaat agagacacac cctgagaga aaataattca    900
ggagaccatc caggctccgg ctcggaactt aatacaaggt ctgttgaaat cgacagttcc   960
atggtctctt acagcatagc agttatagta tccgttaaaa aaccaacccg atttacggac  1020
```

TABLE 3-continued

Sequences disclosed herein.

| | | | | | |
|---|---|---|---|---|---|
| atgcaattgg | aattatgttc | aagggttaaa | gtgttttgga | atacaggtgt | tcctcctaca | 1080 |
| aagacgttta | atgaagaatt | ttataatgct | gcatcaatga | aatggaattt | gaatgatgaa | 1140 |
| aacttcgatt | tgtttgtacc | attaagcata | tccccagatg | atcaaatgat | tgaaaacaac | 1200 |
| tccaacgatc | gtcaaatgag | gttgttcaag | aatattccta | cagaggagag | actgtatttg | 1260 |
| gacaagacta | aaacaaaagc | cagcctttta | aacgccatag | acgtaaataa | gactcatctt | 1320 |
| taccaacctg | gagactatgt | attcttagta | ccagtggttt | tctctaatca | tattccggag | 1380 |
| actatctatt | taccctctgc | acgtgttagt | tacagactaa | ggcttgcaac | aaaaggcaatc | 1440 |
| aatagaaagg | gtttctatcg | tcaagattca | aactctccgc | aacctattgt | gtcgccagac | 1500 |
| tcttcttcat | cactaagctc | cactacatct | tcattaaaac | ttaccgaaac | agaatccgct | 1560 |
| caggcccata | ggaggataag | caacactttg | tttagtaaag | ttaaaaatca | tctacacatg | 1620 |
| agctcacatc | aactgaaaaa | tgaagaatca | ggagaagagg | acattttcgc | agagtatcca | 1680 |
| ataaaagtta | ttagaactcc | accgccgtt | gccgtatcca | ctgcgaataa | accaatctat | 1740 |
| attaataggg | tttggacaga | ttctttgtca | tacgagattt | cctttgctca | gaaatacgtt | 1800 |
| tcactaaaca | gtgaagtccc | aatcaagata | aaattggcac | cgatatgcaa | aaacgtttgt | 1860 |
| gttaaacgta | ttcatgtcag | tattactgaa | agagtcacat | ttgttagtaa | aggttatgaa | 1920 |
| tatgagtatg | atcaaacaga | tcccgttgct | aaagacccctt | ataatccgta | ttatttagat | 1980 |
| ttcgcctcca | agagaagaaa | ggaaagaagt | gtatcattat | ttgaaatcag | aactaaggag | 2040 |
| aagggcacga | gagctctaag | ggaggaaatt | gttgaaaatt | cattcaatga | caatctctta | 2100 |
| tcttatagtc | cttttgatga | cgacagcgat | tcaaaaggca | atccgaaaga | aggctcagt | 2160 |
| ataacggaac | caataattat | tgaaacaaaa | ttgaagttcc | ccaaatacga | agatttggat | 2220 |
| aaaagaaccg | caaagataat | accaccttat | ggtatcgatg | catacacgag | catcccccaat | 2280 |
| cccgaacatg | ccgtagccaa | tggaccctca | caccgtcgtc | ccagtgtaat | aggcttttta | 2340 |
| tccggtcata | aaggctcgaa | aagtcatgaa | gaaaatgaaa | aacctgttta | tgatccaaaa | 2400 |
| ttccatcaaa | caataatcaa | atccaattct | ggtttgcccg | tgaaaacaca | taccagatta | 2460 |
| aacacaccga | aaagaggctt | gtacttggat | agtttacact | tcagtaatgt | ttactgtaga | 2520 |
| cataagctgg | aaattatgct | acgaatcagt | aaacctgatc | ctgagtgtcc | gtccaaatta | 2580 |
| agacattatg | aggttctaat | cgatacgccc | atattcctgg | tgtctgaaca | gtgcaacagt | 2640 |
| ggtaatatgg | agttacccac | ttatgatatg | gccacaatgg | aaggcaaagg | caaccaggtt | 2700 |
| cctctaagta | tgaacagcga | cttttttggt | aacacatgtc | cacctccgcc | aacttttgaa | 2760 |
| gaagccatat | ccgttccagc | ttctcccatt | gtctcaccga | tgggatcacc | taatatcatg | 2820 |
| gcctcgtatg | accctgattt | actatctatt | caacaattga | acttatcaag | aactacgtca | 2880 |
| gttagtgggc | catccggata | cagcgatgat | gccggtgtgc | caaatgttaa | tcggaacagt | 2940 |
| atttcaaatg | ccaatgccat | gaacggcagt | atttcgaatt | ccgcatttgt | ttcgggcaat | 3000 |
| agtggccaag | gtgttgctag | agcaagagca | acgtcagtga | atgacaggtc | aagattcaat | 3060 |
| aatctcgata | aattattgag | cactccatcg | cccgtcaata | gatctcacaa | ttcatcacca | 3120 |
| acaaatggct | tatcacaagc | aaatggtact | gtgaggattc | caaacgctac | cactgaaaac | 3180 |
| tctaaggaca | aacagaacga | attttttcaaa | aaggggttaca | ctttagcgaa | tgtaaaagat | 3240 |
| gatgaagaac | aagaaggaat | agtaagttcg | agctccgcag | attcgctact | ctctcatggt | 3300 |
| aacgagcctc | cgcgttatga | cgaaatagtg | cctttgatga | gtgatgaaga | atga       | 3354 |

SEQ ID NO: 34
```
MPFITSRPVA KNSSHSLSET DLNQSKGQPF QPSPTKKLGS MQQRRSSTI  RHALSSLLGG    60
ANVHSPAVLN NTTKGGNNNG NIRSSNTDAQ LLGKKQNKQP PPNARRHSTT AIQGSISDSA   120
TTTPRSSTSD TNRRTSGRLS VDQEPRISGG RYSQIEEDST VLDFDDDHNS SAVVSSDLSS   180
TSLTRLANSK KFNEQFLIEY LTARGLLGPK TVLSNEYLKI SISTSGESVF LPTISSNDDE   240
YLSRLNGLND GTDDAEADFF MDGIDQQEGN TPSLATTAAA TESGGSINEN RDTLLRENNS   300
GDHPGSGSEL NTRSVEIDSS MVSYSIAVIV SVKKPTRFTD MQLELCSRVK VFWNTGVPPT   360
KTFNEEFYNA ASMKWNLNDE NFDLFVPLSI SPDDQMIENN SNDRQMRLFK NIPTEERLYL   420
DKTKTKASLL NAIDVNKTHL YQPGDYVFLV PVVFSNHIPE TIYLPSARVS YRLRLATKAI   480
NRKGFYRQDS NSPQPIVSPD SSSSLSSTTS SLKLTETESA QAHRRISNTL FSKVKNHLHM   540
SSHQLKNEES GEEDIFAEYP IKVIRTPPPV AVSTANKPIY INRVWTDSLS YEISFAQKYV   600
SLNSEVPIKI KLAPICKNVC VKRIHVSITE RVTFVSKGYE YDQTDPVA KDPYNPYYLD    660
FASKRRKERS VSLFEIRTKE KGTRALREEI VENSFNDNLL SYSPFDDDSD SKGNPKERLG   720
ITEPIIIETK LKFPKYEDLD KRTAKIIPPY GIDAYTSIPN PEHAVANGPS HRRPSVIGFL   780
SGHKGSKSHE ENEKPVYDPK FHQTIIKSNS GLPVKTHTRL NTPKRGLYLD SLHFSNVYCR   840
HKLEIMLRIS KPDPECPSKL RHYEVLIDTP IFLVSEQCNS GNMELPTYDM ATMEGKGNQV   900
PLSMNSDFFG NTCPPPPTFE EAISVPASPI VSPMGSPNIM ASYDPDLLSI QQLNLSRTTS   960
VSGPSGYSDD AGVPNVNRNS ISNANAMNGS ISNSAFVSGN SGQGVARARA TSVNDRSRFN  1020
NLDKLLSTPS PVNRSHNSSP TNGLSQANGT VRIPNATTEN SKDKQNEFFK KGYTLANVKD  1080
DEEQEGIVSS SSADSLLSHG NEPPRYDEIV PLMSDEE                          1117
```

SEQ ID NO: 35

| | | | | | |
|---|---|---|---|---|---|
| atgcccatgg | accaatctat | ctcatctcca | ttgtttccca | tggaaaagga | tattgatatc |  60 |
| cccctcgatg | ctacacccctt | ggcacaaagt | tcatcattac | agcttttat | tcatttagct | 120 |
| gaaccagttg | ttttcctcca | aggctttgac | cctcagaaga | cggaatatcc | ctcggttgtt | 180 |
| cttcggggct | gtctagtggt | aagaatactg | aaacccacaa | agctgaaaag | cataagtctt | 240 |
| tcgttcaaag | gatattctag | aactgaatgg | cctgaaggta | tccctcctaa | aagcaagaa  | 300 |
| ttcgtggaaa | tcaagatat  | tgtagaccat | acatgggctc | tatatccgcc | aactgaacag | 360 |
| aagagcaaga | aaaatgtgga | tgcttccgca | cctaatgaga | gcaacaatgc | agctaataat | 420 |
| ttttgacga  | aggaaagtgg | tgcctctctt | tatagaacac | tgtctgataa | tgaaactata | 480 |
| acaagcagaa | aaaattctat | atcaggtttt | tcctcgttga | acttgtcacc | tctaggtgca | 540 |
| cctgaaaatt | cctctgtcaa | cgtaaaagac | agagaaagta | gacaaagatc | tagatcttcg | 600 |
| tcagtcactt | cttccaatgg | accatcaaga | aacctatccg | cgataaattt | attgaagaga | 660 |
| gccacgtctc | cttccgtgtc | tcaccacaac | tataaaccta | cgaccactc  | catctttttcc | 720 |
| gacttgttga | ataacacctt | taccataat  | gatgcagcat | cgcatcatgg | tcatcatatc | 780 |
| cccaccagta | gcaatcatct | ggcaatgaca | agcaacaact | tcaccagcgg | gtctggagga | 840 |
| gaatttttg  | tcttttcaacc | aggcgactat | atttatgctt | tcgaagaact | aattcctcaa | 900 |
| gcatacccag | aatctattaa | agctgatttc | ggatttgtgg | aatactctt  | atttgccagt | 960 |

TABLE 3-continued

Sequences disclosed herein.

```
atagagagac ctggtgcctt taaatcaaac attagcgccc ggcaagtggt taatatcgta  1020
cggacacagg ctcataattc tgtggaagaa agtgagccga ttatcatatc tagagattgg  1080
gaaaaccaat tatattatga tatcgttata gcatcaaagg atattatttt agatgctttt  1140
ctgcctatca cgttcaaatt cgctcccctc gataaagtta cgttgcatag aataagaatt  1200
tatgtgacag agacaatgga gtattattgt agagaaaaga aggttcatag gatggagccc  1260
accaagaaat ttttattgac agaacagaaa ggtcctaaat taccgaactt gcccaatgat  1320
gcaaatttgt caaaggccaa gaatatgggg aacctgttgc aggatccaaa gaatggtgat  1380
ttagtgaata aagagtatga gtaccagatt tttattccga gtcgtttcaa caaccatcag  1440
caattgcatc cagatacttc ttatgaaaac atcaaagcaa accattggat taaaatttgc  1500
ctgagactgt ctagagtagt agataataaa aggaaacatt acgaaattag tattgactcg  1560
ccaatacatg ttttacatag attgtgctcg catgcaaata cccttttacc gagctatgat  1620
ggacatcctg cttctttttcc aaaagaaaca gattcctcaa tttcctcaat attggaatcg  1680
tctgatgaca atataaatct ataccataac tctaatattt tctttcccaa ggaagtcctt  1740
tcgtctccag tactttcgcc caatgtccaa ccattagaca ttttaatccc acatttacct  1800
tccacttcat tgaccagaaa ctctaggcaa ttcaatagga actcaaaatc ccatccgagt  1860
gataatacca tcttcaattc tgcaaagttg aaatccaaca tatatcaacc ggagagtttg  1920
caaagagaat tagcatcacc ccaggcaatc ccgctctctc caataacatc gccaatgtca  1980
aatatgaag tgcctccgcc agattttgac ttttcttccg atttcatatc tgatgctgct  2040
tccggaacca ctactactga ggtatcttca tcagagtcga gcatcttacc acgggatcca  2100
ccatcttata aggatactgt gttgcatgac aacaatcaaa aaggaggcc taattccaaa  2160
catccgacgc ctccaagttt aaaagcttcc catccaaata aaaattcgga taagaattct  2220
tcagaaactt tgaataaaaa agaatcgatg tcaaagatag aagaaataa acacaaaaga  2280
gagacaactc ctaaaaagag agaaaatagg gacgtgaaaa gtttatcaac cccacaacgc  2340
gaggaaagca aagactcgac atccactggg aatcaaagta acgaaaagaa cagaaaaaga  2400
gtattaagcc tatcgtcttc attacatagc tcaccaaata atagcggatt tgcgcattca  2460
gctttaggaa atctgagcaa tgaatcatta agatcattga atagaaggga aagtgttcaa  2520
gataatttac cgtccacaat aagacacgat aatccttttt tcacagattt aaatcaagtt  2580
ttaatagaag acgaacttaa aaatcatgat aaaaatgaac taaatcgaca ttctacaaat  2640
acttcgagca cccccgcctc agctagatcc tcttttgact attcaggaat taatataagc  2700
aaggacaagt tgaacatgga accattactg agtaaaacgg aaacgttgac taataaagtt  2760
aatgaagact ccttttttaag gcctaatgat tcatacgttg atctacttga accctcagta  2820
gatactacga ttgatatcac tgcgccgtac gctagaaatt cctctgcttg gcatccttta  2880
caaaacgata acgataacaa tcagttttct ccacttttgg gaagtaacga gaatttcttg  2940
aatgcagcta atgcacaaaa ttctgccgaa tcagatcata ataatgacat ttcacacag  3000
ggctcaggat taacggaaag ctctaagaat tctgattccg aggaaagatt tatttcaaga  3060
ctttcttcac ccgagaaagt actgattaat acgttagata tgaatctgg attacaaagt  3120
ataaatgaga gtacccttta g                                             3141

SEQ ID NO: 36
MPMDQSISSP LFPMEKDIDI PLDATPLAQS SSLQLFIHLA EPVVFLQGFD PQKTEYPSVV    60
LRGCLVVRIL KPTKLKSISL SFKGYSRTEW PEGIPPKRQE FVEIKDIVDH TWALYPPTEQ   120
KSKKKMDASA PNESNNAANN FLTKESGASL YRTLSDNETI TSRKNSISGL SSLNLSPLGA   180
PGNSSVNVKD RESRQRSRSS SVTSSNGPSR NLSPINLLKR ATSPSVSHHN YKPTTTSIFS   240
DLLNNTFTHN DAASHHGHHI PTSSNHLAMT SNNFTSGSGG EFFVFQPGDY IYAFEELIPQ   300
AYPESIKADF GFVEYFLFAS IERPGAFKSN ISARQVVNIV RTQAHNSVEE SEPIIISRDW   360
ENQLYYDIVI ASKDIILDAF LPITFKFAPL DKVTLHRIRI YVTETMEYYC REKKVHRMEP   420
TKKFLLTEQK GPKLPNLPND ANLSKAKNMG NLLQDPKNGD LVNKEYEYQI FIPSRFNNHQ   480
QLHPDTSYEN IKANHWIKIC LRLSRVVDNK RKHYEISIDS PIHVLHRLCS HANTLLPSYD   540
GHPASFPKET DSSISSILES SDDNINLYHN SNIFFPKEVL SSPVLSPNVQ PLDILIPHLP   600
STSLTRNSRQ FNRNSKSHPS DNTIFNSAKL KSNIYQPESL QRELASPQAI PLSPITSPMS   660
NMEVPPPDFD FSSDFISDAA SGTTTTEVSS SESSILPRDP PSYKDTVLHD NNQKRRPNSK   720
HPTPPSLKAS HPNKNSDKNS SETLNKKESM SKIEENKHKR ETTPKKRENR DVKSLSTPQR   780
EESKDSTSTG NQSNEKNRKR VLSLSSSLHS SPNNSGFAHS ALGNLSNESL RSLNRRESVQ   840
DNLPSTIRHD NPFFTDLNQV LIEDELKNHD KNELNRHSTN TSSTPASARS SFDYSGINIS   900
KDKLNMEPLL SKTETLTNKV NEDSFLRPND SYVDLLEPSV DTTIDITAPY ARNSSAWHPL   960
QNDNDNNQFS PLLGSNENFL NAANAQNSAE SDHNNDIFTQ GSGLTESSKN SDSEERFISR  1020
LSSPEKVLIN TLDNESGLQS INESTL                                      1046

SEQ ID NO: 37
atgttttcat catcatctcg accttcaaaa gagccattac tatttgacat cagacttaga    60
aatttggaca atgatgtttt actgataaaa ggcccccctg atgaggcatc ttctgtccta   120
ctatctggaa ctatagtatt gtcaattact gagccaattc aaatcaagtc tttggctttg   180
agacttttg gtaggttgag actaaatatt ccaacggttt tacaaactgt tcatgggccg   240
cataagcgat actcaaagtt tgagagaaac atatattctc atttttggga tgattttaat   300
ataaaaagtt atttccaaaa cttgtacgat aatcataata atggtaaaat aacaatttct   360
agtaaatcct caacaaattt agcagcattg ccaaagagaa aaagagccct ttctactgca   420
tcattgatat caagtaatgg gcagacaagc gcaagcaaaa actatcacac cttagtaaaa   480
ggtaactacg aattccctt cagcgcgatt attcctgggt cattagtgga agtgtagaa   540
ggcctaccaa atgctgccgt cacttatgct ctggaagcta ctatcgagag acctaagcag   600
cccgacttga tctgtaaaaa acatctaaga gttattcgaa cgttagctat agatgcagtc   660
gagttatctg aaacagtatc agtggataac tcatggcctg aaaaagtcga ttatacgatc   720
tccattccaa ctaaggcaat tgccattggc tcttccacca tgatcaatat tttaattgtt   780
cctataattaa aaggattgaa gttaggccct gttaggatca gttggtgga aaattcccag   840
tattgtggta gctatggagg ggttatcaac caagaagaa tggtggctaa attaaaacta   900
aaagatcccc tgaagcacgt tgcccaaata aagaagaaga ggagcctaaa tgaagctgcc   960
gacgaagggg ttgatacgga cacagggaaa tttcaagata aatgggaagt tcgagcttta  1020
ttaaacatac ctgcaagcct gactaaatgc tcccaagact gtcgcatttt atctaatatc  1080
aaagtccgtc ataagatcaa gttcactata agttactcta atccggacgg tcatatttca  1140
```

TABLE 3-continued

Sequences disclosed herein.

```
gaattgcgtg cggcactgcc tgtccaatta ttcatttcac cgtttgttcc agtcaatgta  1200
aagacctccg atgttattga aagaacgctc aaaacgtttg gaccctcata tcaagtaaca  1260
agtcagcacg ataattcatt cagcagcaaa aactttgtag acgatagtga agaagatgtg  1320
attttttcaaa gatctgcttc tgcgttacaa ttgtcttcaa tgccaaccat agtatctggc  1380
tctactttaa atatcaatag tactgatgca gaggctaccg cagtcgctga cacaactatg  1440
gtaactagtt tgatggtacc tcccaactac ggcaatcacg tttacgatcg agtgtatggc  1500
gaggtaacta atgaagacga aacttcagca tcagcttctt caagtgccgt cgaatcacag  1560
gcaattcaca atattcaaaa cctatatata tcggatagta acaatagcaa taatcctatt  1620
ttggcaccaa atcctcaaat caagattgaa gatgatagcc taaataattg tgactctcga  1680
ggggacagcg ttaacaatag taacctgaat ctggttaata gtaatctaac aattagtgaa  1740
aattggaaca ataactctcc ttctgcaaat agatataata acatcattaa tgctggattg  1800
aatagtcctt cactgacacc aagctttgca catttatcta ggcgtaactc atatagtcgc  1860
caaacatctt ctacatcgct gaagaacgat ttggaactga cagatttaag cagagttccc  1920
tcgtatgata aagcaatgaa atctgatatg attggtgagg atcttccacc ggcttatccc  1980
gaggaagaac ttggagttca agaaaataaa aaaattgaac tagaaaggcc acaaattctt  2040
catcacaagt ctacatcctc tttgttgcca cttccaggct cgagcaagag ttccaataat  2100
ctgaaaagat cgtctagtag gacacattta tcccactctc cattaccaag gaataatagc  2160
ggatcctcag tatcattgca gcagttggcg agaaacaaca cagatagttc atttaatcta  2220
aatctctctt tcacttcagc aaaaagcagc acaggaagca gacattttcc gtttaatatg  2280
acaacatctt tcactagtaa ttcaagttcc aagaacaatt cacattttga taaaactgat  2340
tctacatctg acgctaataa gccaagagaa gaggaaaact atacgagcgc aacccacaat  2400
cgaaggtcac gctcatcgtc agttcggagc aacaatagca actcaccatt aagacaagga  2460
acaggttcat ttgctaattt aatggagatg ttcacaaaac gggatcgctc atag        2514
```

SEQ ID NO: 38
```
MFSSSSRPSK EPLLFDIRLR NLDNDVLLIK GPPDEASSVL LSGTIVLSIT EPIQIKSLAL   60
RLFGRLRLNI PTVLQTVHGP HKRYSKFERN IYSHFWDDFN IKSYFQNLYD NHNNGKITIS  120
SKSSTNLAAL PKRKRALSTA SLISSNGQTS ASKNYHTLVK GNYEFPPFSAI IPGSLVESVE  180
GLPNAAVTYA LEATIERPKQ PDLICKKHLR VIRTLAIDAV ELSETVSVDN SWPEKVDYTI  240
SIPTKAIAIG SSTMINILIV PILKGLKLGP VRISLVENSQ YCGSYGGVIN QERMVAKLKL  300
KDPLKHVAQI KKKRSLNEAA DEGVDTDTGE FQDKWEVRAL LNIPASLTKC SQDCRILSNI  360
KVRHKIKFTI SLLNPDGHIS ELRAALPVQL FISPFVPVNV KTSDVIERTL KTFGPSYQVT  420
SQHDNSFSSK NFVDDSEEDV IFQRSASALQ LSSMPTIVSG STLNINSTDA EATAVADTTM  480
VTSLMVPPNY GNHVYDRVYG EVTNEDETSA SASSSAVESQ AIHNIQNLYI SDSNNSNNPI  540
LAPNPQIKIE DDSLNNCDSR GDSVNNSNLN LVNSNLTISE NWNNNSPSAN RYNNIINAGL  600
NSPSLTPSFA HLSRRNSYSR QTSSTSLKND LELTDLSRVP SYDKAMKSDM IGEDLPPAYP  660
EEELGVQENK KIELERPQIL HHKSTSSLLP LPGSSKSSNN LKRSSSRTHL SHSPLPRNNS  720
GSSVSLQQLA RNNTDSSFNL NLSFTSAKSS TGSRHFPFNM TTSFTSNSSS KNNSHFDKTD  780
STSDANKPRE EENYTSATHN RRSRSSSVRS NNSNSPLRQG TGSFANLMEM FTKRDRS     837
```

SEQ ID NO: 39
```
atgctccaat tcaatacaga aaatgatact gtagctccag tgtttcccat ggagcaagat    60
ataaatgcag cacctgatgc cgtcccactg gtgcagacaa caacactaca agtctttgta   120
aagcttgccg aacccatagt gtttttaaaa ggatttgaaa ctaacggact gtctgaaata   180
gcccccagta tcttacgagg atctcttatc gtcagggtgt tgaaaccgaa taaattaaaa   240
agtatatcga taaccttcaa aggaatatcc agaacagagt ggccggaagg tataccaccg   300
aagagagaag aattttcaga tgttgaaact gttgtcaatc acacatggcc atttatcag    360
gcggatgacg gcatgaattc tttcaccttaa gaacatcaca gctcaaataa ttcgtccaat   420
cgcccatcta tgagcgatga agattatcta cttgaaaaaa gcggtgcttc agtatatatc   480
ccaccaaccg ctgaaccccc taaagataat agcaatctaa gtctggatgc ctatgagcgc   540
aactcattgt catccgataa tttgagtaac aagccagtat caagtgatgt ttcccatgac   600
gacagtaaac tgttggctat tcaaaagaca ccattaccat catctagtcg aagaggatcg   660
gtaccggcaa attttcacgg taactctttg tcacctcata ccttcatatc tgatttgttt   720
acaaaaacat tcagtaatag tggcgctact ccaagtcctg agcaagagga taactatctt   780
acaccatcca aagattctaa agaagttttt atttttcgac cgggcgatta tatttacact   840
tttgaacagc aatatcgca atcttatcca gaaagtataa aagccaattt tggttccgtg   900
gagtataaac tgtcaataga catagagagg tttggcgtat tcaaatcaac tatacatact   960
caattaccca tcaaagtcgt aaggcttcct tctgatggat ccgtagaaga gactgaagct  1020
attgcaattt ccaaggactg gaaagatctt ctccattatg acgtggtaat tttctcgaaa  1080
gagatcgttt tgaatgcatt tttacccatc gatttccatt tcgctcctct agataaagtt  1140
actctgcatc gtattagaat ttatctaaca gagtctatgg aatacacttg taatagtaat  1200
ggaaatcacg agaaggctcg tagattagag ccaactaaaa agtttctgtt ggctgaacat  1260
aacggtccta aactgcctca tataccagct ggttcgaatc ctttgaaggc taaaaataga  1320
gggaacatcc tcttggatga aaaatccggc gatctagtta caaagatttt cagttcgag   1380
gtgtttgtcc caagcaagtt tacaaacagt atacggttac accctgatac aaatttatgat  1440
aaaatcaaag cccaccattg gataaaaatt tgccttcgtc tttccaagaa gtacgggac   1500
aatagaaaac atttcgaaat aagtattgat tctccaatcc atatttaaaa tcaactatgc  1560
tcacacgcga atactttgct accgagctac gagagtcatt ccagtattg tgatgaagat  1620
ggtaatttcg caccagcagc agatcaacaa aattacgaca tgcatcatga ttccaatatt  1680
ttcttcccaa aagaagttct ttcgtctccc gttctttcac ctaacgtgca gaagatgaac  1740
attagaaatac cgtctgatct tccagtagtg cgtaatagaa ctgaaagcgt aaagaaaagc  1800
aagtcagata taacctccaa gaagaatgat caaagtagca atgtcttcgc atccaaacag  1860
ctggtcgcaa acatttataa gcccaatcag attccaagag aattaactt tcctcaggcg  1920
ttaccattat cgcccatcac ctcaccaatt tcaattacc aaccattatc aaactccccg  1980
cctcagatt tgatttga tctagctaag cgcggcgcag ccgattctca tgctattcct  2040
gtggatcctc catcatattt tgatgtatta aaggccgatg ggattgaatt gccatactac  2100
gatacaagtt catctaaaat tcctgaacta aaactaaca aatctagaga acattggcc  2160
agcattgagg aggactcatt caatggttgg tctcaaattg atgacttatc cgacgaagat  2220
```

TABLE 3-continued

Sequences disclosed herein.

```
gacaatgatg gcgatatagc atctggtttc aacttcaagc tgtcaaccag tgctccgagt    2280
gagaacgtta attcacacac tcctattttg cagtctttaa acatgagtct tgatgggaga    2340
aaaaaaaatc gtgccagtct cacacgcaaca tcagtgttac ctagtacaat aagacagaac   2400
aatcagcatt tcaatgacat aaaccagatg ctaggcagta gtgacgaaga tgcctttccc    2460
aaaagccaat cattaaattt caataagaaa ctaccaatac ttaaaattaa tgataacgtc    2520
atacaatcaa acagcaatag taataacaga gttgataatc cagaagatac agtggattct    2580
tcagtcgata ttacagcatt ttatgatcca agaatgtcat cagattccaa atttgattgg    2640
gaggtaagca agaaccatgt tgacccagca gcctactcgg ttaacgttgc tagtgaaaac    2700
cgtgtactgg acgactttaa gaaagcattt cgcgaaaaga gaaaataa                 2748

SEQ ID NO: 40
MLQFNTENDT VAPVFPMEQD INAAPDAVPL VQTTTLQVFV KLAEPIVFLK GFETNGLSEI      60
APSILRGSLI VRVLKPNKLK SISITFKGIS RTEWPEGIPP KREEFSDVET VVNHTWPFYQ     120
ADDGMNSFTL EHHSSNNSSN RPSMSDEDYL LEKSGASVYI PPTAEPPKDN SNLSLDAYER     180
NSLSSDNLSN KPVSSDVSHD DSKLLAIQKT PLPSSSRRGS VPANFHGNSL SPHTFISDLF     240
TKTFSNSGAT PSPEQEDNYL TPSKDSKEVF IFRPGDYIYT FEQPISQSYP ESIKANFGSV     300
EYKLSIDIER FGAFKSTIHT QLPIKVVRLP SDGSVEETEA IAISKDWKDL LHYDVVIFSK     360
EIVLNAFLPI DFHFAPLDKV TLHRIRIYLT ESMEYTCNSN GNHEKARRLE PTKKFLLAEH     420
NGPKLPHIPA GSNPLKAKNR GNILLDEKSG DLVNKDFQFE VFVPSKFTNS IRLHPDTNYD     480
KIKAHHWIKI CLRLSKKYGD NRKHFEISID SPIHILNQLC SHANTLLPSY ESHFQYCDED     540
GNFAPAADQQ NYASHHDSNI FFPKEVLSSP VLSPNVQKMN IRIPSDLPVV RNRAESVKKS     600
KSDNTSKKND QSSNVFASKQ LVANIYKPNQ IPRELTSPQA LPLSPITSPI LNYQPLSNSP     660
PPDFDFDLAK RGAADSHAIP VDPPSYFDVL KADGIELPYY DTSSSKIPEL KLNKSRETLA     720
SIEEDSFNGW SQIDDLSDED DNDGDIASGF NFKLSTSAPS ENVNSHTPIL QSLNMSLDGR     780
KKNRASLHAT SVLPSTIRQN NQHFNDINQM LGSSDEDAFP KSQSLNFNKK LPILKINDNV     840
IQSNSNSNNR VDNPEDTVDS SVDITAFYDP RMSSDSKFDW EVSKNHVDPA AYSVNVASEN     900
RVLDDFKKAF REKRK                                                     915

SEQ ID NO: 41
atgggcttca gtagcggtaa atcaactaag aaaaagcctc tgcttttcga tatcagactt      60
aaaaatgttg acaacgatgt aatactcctc aaaggtcctc caaacgaggc cccctcggtg    120
cttttatctg gttgcatcgt tttatcgatt aacgaaccca tgcagatcaa aagcatatca    180
ttgagacttt atgggaagat acaaatagac gtaccattag agaggcccca ggacgctagt    240
tcttcgtcgt tgtcttcatc gccgccaaag atcagaaagt acaacaaagt tttttataat    300
tacgcatggg ataatgttaa cctcaaggag tatctgagtg gttaagagg gcaatctggc     360
cttgcgggca gtagctcatc aagtaaatat ctgggcactc gccaaagagc tcagtccaca    420
agttccttga agtctttaaa ggggtcctcc tcaccctctt catgtacttt agataagggc    480
aactacgatt tcccctttag tgctattttg cctggttcgt taccagagag cgtagaatct    540
ttgccaaatt gcttcgtgac atatagcatg gaatccgtta ttgaacgcag caaaaattat    600
agtgatttga tctgtaggaa aaatattaga gttctgagaa ccatttcacc cgcagcagtg    660
gagttatcag aaactgtttg tgtagataac tcatggcccg acaaagtgga ttattctatt    720
tcagtaccca acaaagccgt agctattggt tcagccaccc ctataaatat ttccattgta    780
cctctttcga aggtttgaa attgggctca atcaaagtcg tattatttga gaattatcaa     840
tattgtgacc ccttccctcc agtaatttct gaaaaatgac aagtgacaga actaaatctt    900
gaagatccct tgaacgagtc atctggaaga tttaatggta atggttgctt tgtaaataac    960
cccttttttc agcctgatca ttcattccaa gacaagtggg agattgatac catccctgcaa  1020
atcccgaaca gcttataaaa ctgtgtgcaa gattgtgatg tccgctctaa cattaaggtt   1080
cgccataagc tcaaattttt catcatccta attaacccag atggtcataa atctgagtta   1140
agagcgtcct taccgattca acttttatt tcaccatttg tggcactttc aataaaaacca   1200
ttgtcatcct cgaatttgta ttcgcttttt agcaccacta accagaaaga cgaaaactca   1260
tcacaagaag aggaagagga atatctgttt tctagatcag catcagtcac agggttggaa   1320
ttattagcgg atatgcgtag cggtggctct gttcctacca tttcagactt gatgacgccc   1380
ccaaattatg aaatgcacgt atatgatcgt ctttatagcg gttctttcac tcgcacggct   1440
gtggaaacgt ctggaacatg tactccttg gaagcgaat gttcgactgt cgaggatcag    1500
caacaggatt tagaagattt acgtatacgg ttgacaaaaa ttagaaatca acgtgacaat   1560
ctagggctac caccgtctgc ctcgtctgct gccgcttcca gatcgctatc tccattacta   1620
aacgttccag caccaggaga tggcacggag agaatcttac ctcagagtgc tcttggtccc   1680
aatagtggct ctgtgccagg agtacatagt aacgtatcac ctgtttttact ttcaagatcc   1740
ccagccccaa gcgtgtcagc ccatgaagtg ttaccagtgc cctcgggctt aaattatcca    1800
gagactcaaa acctgaacaa ggttccatcg tatggcaagg caatgaaata tgatatcatt    1860
ggtgaggacc ttcctccttc ctacccttgt gcgatacaaa atgtgcaacc aagaaaaccc    1920
agtagggtac attccaggaa ctcttcgaca acattgtcat cttctatacc aactagcttt    1980
cattcctcta gttttatgag tagcactgct tcccctattt ccataattaa tggctctaga    2040
agtagttcta gtggggtatc tcttaataca cttaatgagt taacttcgaa aacttcgaat    2100
aacccatcca gtaatagtat gaaaaggtca ccaacaagac ggagggctac ttctttagct    2160
gggtttatgg gaggttttct atcaaagggt aacaaacgat ag                       2202

SEQ ID NO: 42
MGFSSGKSTK KKPLLFDIRL KNVDNDVILL KGPPNEAPSV LLSGCIVLSI NEPMQIKSIS      60
LRLYGKIQID VPLERPQDAS SSLSSSPPK IRKYNKVFYN YAWDNVNLKE YLSGLRGQSG     120
LAGSSSSSNI LGTRQRAQST SSLKSLKGSS SPSSCTLDKG NYDFPFSAIL PGSLPESVES    180
LPNCFVTYSM ESVIERSKNY SDLICRKNIR VLRTISPAAV ELSETVCVDN SWPDKVDYSI    240
SVPNKAVAIG SATPINISIV PLSKGLKLGS IKVVLFENYQ YCDFPPVIS ENRQVTELNL     300
EDPLNESSGE FNGNGCFVNN PFFQPDHSFQ DKWEIDTILQ IPNSLSNCVQ DCDVRSNIKV    360
RHKLKFFIIL INPDGHKSEL RASLPIQLFI SPFVALSIKP LSSSNLYSLF STTNQKDENS    420
SQEEEEEYLF SRSASVTGLE LLADMRSGGS VPTISDLMTP PNYEMHVYDR LYSGSFTRTA    480
VETSGTCTPL GSECSTVEDQ QQDLEDLRIR LTKIRNQRDN LGLPPSASSA AASRSLSPLL    540
NVPAPEDGTE RILPQSALGP NSGSVPGVHS NVSPVLLSRS PAPSVSAHEV LPVPSGLNYP    600
```

TABLE 3-continued

Sequences disclosed herein.

| | | | | | |
|---|---|---|---|---|---|
| ETQNLNKVPS | YGKAMKYDII | GEDLPPSYPC | AIQNVQPRKP | SRVHSRNSST | TLSSSIPTSF | 660 |
| HSSSFMSSTA | SPISIINGSR | SSSSGVSLNT | LNELTSKTSN | NPSSNSMKRS | PTRRRATSLA | 720 |
| GFMGGFLSKG | NKR | | | | | 733 |

SEQ ID NO: 43

```
atgcaatcta ctgtcccaat agcaattgcg agcaacggca acaagagaga tgtcgtccag    60
aacgtttctg caggcgacga gggtgatata ttgcaaaggc tagcccgtaa cagagagatg   120
atttctacct ccctcctcgcc acaaaaatcg tcaggattta gtggtagaag aggtcatct   180
agtgttaggg acgcccttttc ttcttttttt ggaactggta atagtccaac atctagtatg   240
gacgattatt ccaatttgat gaaccgtaac tattctaccg catcaactgc catgtgtagg   300
gggaacagtt ttccttcaga tgttggcact aaggcttaca atattacggg atcttaccaa   360
ccggataggc acaggaattc tgttccgtat accaccatag accagttaca cacaaggcaa   420
gacaccgggt tgaggagaga gtcagatcca gtcgcggcaa aacaaatatc tagtaataat   480
gatattgtta ggtcattcat aacacatcat gctagtaata gcactatgtt tattaatagg   540
gtgctatcgg actatttagc ggatcgtggt ttcatcaagc aaacaccgtt atataataag   600
aaaagtgtgc tggaaatttc cattgcaaca agtgcagaat cagttttctt gccaactaca   660
aaaagtgatg aaacagagta tctatcactg attcatggtt ctttaaatca ggcgcgaaca   720
cagcctgtcg ggtccactaa cactgcagaa agtgatttcc tcccttcatg tcctacgatg   780
gacactttga atgaaaacaa tgatttatca ctatttccgt tacatacaca gcgaaccagc   840
ccctctaata cagcaaggac aggtaatgct atggacataa gcaattctga tcgtgcttct   900
ccggcctcga acaataacac aacagatgcg gattcctttg ttgcgagtgg caataacaac   960
cctatgaata ataacaattc tcccgcgaga aacagacatc ctaattctca ctcgcgttct  1020
cttcctaatg cttggaatag ccaaatgcct tcattcagct ttgcattgat attttcctg   1080
aataaatcaa ctaccctttc tgatattaaa gtagaactca cttctaacgt gagagtggtg  1140
tggttcaatg gtcttccccc taccaagaat gttaacgagg aatgctataa tataggttct  1200
ttggactgga ccttaaatgc agacaacttt aatcttttca ttccgcaagg cgcaaagtct  1260
cctcttgata tcgttgaaaa tcattccaat aacaggaaat tgaaagtgct ccagaaatta  1320
tcgatgagga aacgccgttc tttctcgaat aaagcagttc ttagggaaaa tatattaaac  1380
aatttaaatg cctcgaattc tacgaacaag ttaaatgctg gtgtttatgt ctttactatc  1440
cccatagtgc ttgccagtcg tattcctgaa tcgctttact acccatcagc gagggtatcc  1500
tacagcttaa gattagcgac aaaattgaag gatgaacata cacagttggt tgcatcacgg  1560
ccacgttctt cttctatctc ttctcctcaa aaactgcgtt catattcctg ttctgattct  1620
tatgaatatt ctcaaattga tgacaccata gaaggagaaa cctacaataa cgacaaaaat  1680
tctactggaa aaatcgcatt tccctcctca tggttaaaaa gtgcgaaggg cgcttaaaa   1740
aggaataatt ctaacggaag gtcagataat aatgcgcat cttctagtgg tttagccgatg   1800
caacatgatt ctgaagcac tataaattta cagtacccgc ttaatttgat gagaactccg  1860
ccagaaatct ctgtcactac agcaaataag ccactttaca ttaacaaggt ttgggagaat  1920
tgtctttctt atgaaatttc attcgcccaa agtatgtgc ccttgaatgg tgaaattcca  1980
atcacaatta aagtggcacc tctagtaaaa agtcttagtg tcaagagaat tcgtgttagt  2040
tgtagagaaa aaatctccta caggagtaaa gactatcaat atgattttga ccagttggat  2100
ccattggctt cagatccttg caatccctat catatgagat atttagtgag aaaaaagaag  2160
gacagaagct tgcctctatt tgaggtggcc tctaaatgta ctagtgggcc ttctattaga  2220
gaggaagttg tcaccaatac agttgatgat aacttattag cctacacttc atcaaaagaa  2280
aacaacaaag atatcccatt ttctgagtcc tttactgtta aaacgaagtt aaaattttca  2340
aaatattgtg aagtggacgc taccaaagct gcaagtctac caccatatgg tatcgatctt  2400
ttcgacccaa taaagatcc aactcagagt gagaacacct ctaataacgg caatgtattg  2460
ggctttctag tgggtcgccc taacagggct tccaagacag ttcataaaat accgcaagac  2520
aagaatcata atgaggtcaa tgatacaaat ggaaactcga acatatcttt gcaaactagc  2580
tcgaatgttc ccattcagca ctacacacgg ttgaataaac caagacgcgg tttatatttg  2640
gacagtatgc attttaagaa tatccaatgt tctcataaat tagaaatcgt cttgagggtt  2700
agcaaaactg atagtggtag ctcaaaaatc ataaggcatt atgaagtaat tgttgataca  2760
ccaatttatt tgattctga cctttgtaac acttcaaata tagacttacc gacttatgac  2820
atggccacca ctgaatcttc taaagtcctg ccaccaactt tgaagaggc aacatcagtt  2880
tcagcatcac caagatcttc tgtatcttat tatcccgatg acatttccat gcaacagttg  2940
aatttgtcta ggtcgacttc cctcgcaaat ggttacctgt caaccttaca tccaaaaaca  3000
accgctgttt cggactcgtc taacggtgcc ccaatccggg accagcaaga gcaacaagca  3060
cgccccttga ggactgaaga ttatgcgcta caaatggagt gtgaaaataa cgcctatagc  3120
aatatggacg gtttgctttc gcaggatatc tttgaacagg agaccgcggc cacgctattt  3180
aaaagagaca ttgtcacaat gaactttaac aataatatat tcacaccacg gtatagtccg  3240
cgcacttttta ccaataccga ctacaattat aatgataatg ataatgataga taatgataca  3300
gagggggcctg gtccaataat tcatccgggt cctgaaccac aagatatgaa cgagatttca  3360
tcataa                                                             3366
```

SEQ ID NO: 44

| | | | | | |
|---|---|---|---|---|---|
| MQSTVPIAIA | SNGNKRDVVQ | NVSAGDEGDI | LQRLARNREM | ISTSLSPQKS | SGFSGRRRSS | 60 |
| SVRDALSSFF | GTGNSPTSSM | DDYSNLMNRN | YSTASTAMCR | GNSFPSDVGT | KAYNITGSYQ | 120 |
| PDRHRNSVPY | TTIDQLHTRQ | DTGLRRESDP | VAAKQISSNN | DIVRSFITHH | ASNSTMFINR | 180 |
| VLSDYLADRG | FIKQTPLYNK | KSVLEISIAT | SAESVFLPTT | KSDETEYLSL | IHGSLNQART | 240 |
| QPVGSTNTAE | SDFLPSCPTM | DTLNENNDLS | LFPLHTQRTS | PSNTARTGNA | MDTSNSDRAS | 300 |
| PASNNNTTDA | DSFVASGNNN | PMNNNNSPAR | NRHPNSHSRS | LPNAWNSQMP | SFSFALIFSL | 360 |
| NKSTTLSDIK | VELTSNVRVV | WFNGLPPTKN | VNEECYNIGS | LDWTLNADNF | NLFIPQGAKS | 420 |
| PLDIVENHSN | NRKLKVLQKL | SMRKRRSFSN | KAVLRENILN | NLNASNSTNK | LNAGVYVFTI | 480 |
| PIVLASRIPE | SLYYPSARVS | YSLRLATKLK | DEHTQLVASR | PRSSSISSPQ | KLRSYSCSDS | 540 |
| YEYSQIDDTI | EGETYNNDKN | STGKIAFPSS | WLKSAKGRLK | RNNSNGRSDN | NGASSSGLAM | 600 |
| QHDSEDTINL | QYPLNLVRTP | PEISVTTANK | PLYINKVWEN | CLSYEISPAQ | KYVPLNGEIP | 660 |
| ITIKVAPLVK | SLSVKRIRVS | CREKISYRSK | DYQYDFDQLD | PLASDPCNPY | HMRYLVRKKK | 720 |
| DRSLPLFEVA | SKCTSGPSIR | EEVVTNTVDD | NLLAYTSSKE | NNKDIPFSES | FTVKTKLKFP | 780 |
| KYCEVDATKA | ASLPPYGIDL | FDPIKDPTQS | ENTSNNGNVL | GFLVGRPNRA | SKTVHKIPQD | 840 |

TABLE 3-continued

Sequences disclosed herein.

| | | | | | |
|---|---|---|---|---|---|
| KNHNEVNDTN | GNSNTSLQTS | SNVPIQHYTR | LNKPRRGLYL | DSMHFKNIQC | SHKLEIVLRV | 900
| SKTDSGSSKI | IRHYEVIVDT | PIYLISDLCN | TSNIDLPTYD | MATTESSKVL | PPTFEEATSV | 960
| SASPRSSVSY | YPDDISMQQL | NLSRSTSLAN | GYLSTLHPKT | TAVSDSSNGA | PIRDQQEQQA | 1020
| RPLRTEDYAL | QMGNENNAYS | NMDGLLSQDI | FEQETAATLF | KRDIVTMNFN | NNIFTPRYSP | 1080
| RTFTNTDYNY | NDNDNNDNDT | EGPGPIIHPG | PEPPRYDEIS | S | | 1121

SEQ ID NO: 45

```
atggccaaag atttgaacga ttcggggttt ccaccgaaga ggaagccttt gctgcgtcct    60
caacgatctg attttaccgc aaatagttcg acaactatga acgttaatgc aaacacaagg   120
gggcgtggta ggcagaaaca agagggtggt aaaggcagtt cgaggtcacc gtcgttacac   180
tctccaaaat catggataag aagcgcgtct gctacgaggg tccttggact aagacgtccc   240
gaactagcac attctcattc gcatgctcct tccaccggaa cgcctgctgg aggtaatcgt   300
tctcctttga agatcaact gcaaatgcg accccgtcg agaccggaag gtccttgacc    360
gacggagata tcaacaatgt tgttgatgta ctgcccctcat ttgagatgta caataccctg   420
cataggcaca ttccgcaggg caacgtcgat ccagatgcc atgatttcca accttcgtac   480
caagaggcca ataattctac tgcaacaggt gctgcgggct cgagcgctga tctctccat   540
caatcattgt ccactgacgc attgggtgcc acacgttctt cgtcaacatc aaatttagaa    600
aacttaattc cccttcgaac cgaacatcac agtattgcag cacatcaatc aaccgctgtc   660
gatgaagatt cactggatat acctcccata tttgatgact tgaacgatac agacaacatt   720
ttcatcgaca aattgtacac tttaccaaaa atgtccacac catcgaaat caccatcaag   780
acgacgaagc atgcacctat accacacgtg aagccgagg aggagtccat tttgaaagag   840
tatacgtcgg gggatttgat tcatggtttt atcactattg aaaacaaatc tcaagcaaac   900
ctaaagtttg aaatgttcta tgtcactttta gagtcttaca tttccattat tgataaagta   960
aagagtaaaa gaaccgattaa acggttttta aggatggtga acttgagcgc ttcttggtca  1020
tactcgaaaa tagcactggg gtccggtgtg gacttcattc ccgcagatgt tgactacgat  1080
ggttctgtat ttgggctaaa caatagccgg gttctggaac ccggagtcaa gtacaagaaa  1140
ttcttcattt tcaaattgcc actgcaattg ctagatgtca cttgtaagca ggagcatttc  1200
tctcattgtt tgttacctcc cagttttggt attgataaat agtggaacaa ttgcaaatat  1260
tccggtatca aagtcaatag ggtacttggg tgcggtcatt taggtacaaa gggctccccc  1320
atcttaacta acgatatgtc tgatgacaac ctttcgatca attacactat tgatgcaagg  1380
attgtcggta aagatcaaaa ggcctctaaa ctgtatatta tgaaggaaag agaatataat  1440
ctaagagtaa tccctttttgg ttttgacgcc aatgtcgtcg agaaagaac cactatgagt  1500
cagctgaatg atatcaccaa actagtgcag gaaaggttgg atgctcttag aaaaatcttt  1560
cagagattag agaaaaaaga acccataacg aaccgcgaca ttcacggtgc agacttgagt  1620
ggtaccattg atgattctat tgaatcagac tcccaagaaa ttttgcagag gaaattggac  1680
caactgcaca ttaagaacag aaataactat ttagtcaact ataacgattt gaagttgggc  1740
cacgatttgg acaatggccg cagtggaaat agtggtcata taccgatac ttccagagct  1800
tggggtccct ttgttgaaag tgaactaaaa tataaactga aaaacaaatc caattcctcc  1860
tcatttctga acttctctca ttttttaaac agcagttcca gctcaatgtc ctcttcctca  1920
aatgcgggaa agaataatca tgatttaacg ggaaataaag aaaggacagg gctaatacta  1980
gtaaaggcga aaattccaaa acagggccta ccatattggg ctcccctcat tttgagaaag  2040
accaatgttt ttgaatctaa gagtaaaca gaccaagaaa attgggtgag attgtctgag  2100
ttgattccgg aagacgtaaa aaaaccattg gaaaaacttg atttacaatt gacttgcata  2160
gaatccgata atagcttacc tcatgatccg ccagaaattc aatcgattac cacagaactg  2220
atatgtataa ctgctaaatc tgataattct atcccaataa aactcaattc tgaactgttg  2280
atgaacaaag agaagctgac aagcatcaaa gctttgtacg atgatttcca ttcaaaaatt  2340
tgtgaatatg aaaccaagtt caacaagaat tttcttgaat taaatgagtt atataatatg  2400
aatagggag accgtaggcc aaaggaactg aaatttacag attttattac ttcacagctg  2460
tttaacgata tcgaaagcat ttgcaacttg aaagttagtg ttcacaactt atccaacatt  2520
tttaaaaaac aggtcagtac cctaaaacaa cactcaaagc acgcattatc tgaggattca  2580
atatcgcaca caggtaacgg tagttcatcg tcgcccagtt cagcgtcatt aacgccagta  2640
acttcttcat ccaagagtag tttatttta cctagcggta gctcgtctac ttccctgaaa  2700
tttacagacc agattgttca taaatgggtt aggattgctc ctttacagta caaacgagac  2760
attaatgtga acttggaatt taataaggac attaaggaaa cttttaattcc aagttttgaa  2820
agctgcctat gttgtaggtt ttattgcgtt cgagtaatga ttaaatttga aaaccatctt  2880
ggcgtagcga agattgatat ccctatttct gttaggcaag tgacaaaata a           2931
```

SEQ ID NO: 46

| | | | | | |
|---|---|---|---|---|---|
| MAKDLNDSGF | PPKRKPLLRP | QRSDFTANSS | TTMNVNANTR | GRGRQKQEGG | KGSSRSPSLH |  60
| SPKSWIRSAS | ATGILGLRRP | ELAHSHSHAP | STGTPAGGNR | SPLRRSTANA | TPVETGRSLT | 120
| DGDINNVVDV | LPSFEMYNTL | HRHIPQGNVD | PDRHDFPPSY | QEANNSTATG | AAGSSADLSH | 180
| QSLSTDALGA | TRSSSTSNLE | NLIPLRTEHH | SIAAHQSTAV | DEDSLDIPPI | LDDLNDTDNI | 240
| FIDKLYTLPK | MSTPIEITIK | TTKHAPIPHV | KPEEESILKE | YTSGDLIHGF | ITIENKSQAN | 300
| LKFEMFYVTL | ESYISIIDKV | KSKRTIKRFL | RMVDLSASWS | YSKIALGSGV | DPIPADVDYD | 360
| GSVFGLNNSR | VLEPGVKYKK | FFIFKLPLQL | LDVTCKQEHF | SHCLLPPSFG | IDKYRNNCKY | 420
| SGIKVNRVLG | CGHLGTKGSP | ILTNDMSDDN | LSINYTIDAR | IVGKDQKASK | LYIMKEREYN | 480
| LRVIPFGFDA | NVVGERTTMS | QLNDITKLVQ | ERLDALRKIF | QRLEKKEPIT | NRDIHGADLS | 540
| GTIDDSIESD | SQEILQRKLD | QLHIKNRNNY | LVNYNDLKLG | HDLDNGRSGN | SGHNTDTSRA | 600
| WGPFVESELK | YKLKNKSNSS | SFLNFSHFLN | SSSSSMSSSS | NAGKNNHDLT | GNKERTGLIL | 660
| VKAKIPKQGL | PYWAPSLLRK | TNVFESKSKH | DQENWVRLSE | LIPEDVKKPL | EKLDLQLTCI | 720
| ESDNSLPHDP | PEIQSITTEL | ICITAKSDNS | IPIKLNSELL | MNKEKLTSIK | ALYDDFHSKI | 780
| CEYETKFNKN | FLELNELYNM | NRGDRRPKEL | KFTDFITSQL | FNDIESICNL | KVSVHNLSNI | 840
| FKKQVSTLKQ | HSKHALSEDS | ISHTGNGSSS | SPSSASLTPV | TSSSKSSLFL | PSGSSSTSLK | 900
| FTDQIVHKWV | RIAPLQYKRD | INVNLEFNKD | IKETLIPSFE | SCLCCRFYCV | RVMIKFENHL | 960
| GVAKIDIPIS | VRQVTK | | | | | 976

TABLE 3-continued

Sequences disclosed herein.

```
SEQ ID NO: 47
atgactttta cattctccac ttcatcaagg aaaaatggga gacctccttt aaaatcagtt      60
tctacggaag ataacattca tctattgagg aagcggcgtc aacagcagct gtcaagtaat     120
tctacagata attcgctgca tccaaatagt gggcagactc cacgtgcaag tgacagccag     180
gacgatgaca tacgcagcgc ttcaacaacc aatttagacc gtttacgaca agaacgagag     240
gaaaattcac tggaaatgga ctgcacacag tcaagattat ctcatagagc aaatatgcta     300
gtggatgtcc taccatcttt tgagatgtat aatgccttgc acagacacat acctcaagga     360
aacgttgatc ccgatagaca tgatttcccc ccttcttatc aagaagttcg cactcaaaga     420
atgactatat tgcccagcaa tgataattcc gtggaaaggt cacaattgac agcagtgcca     480
ggatccgaaa acgcatgtaa taatgcgact gcccattctc ttaccaacct acatcctcta     540
caaacacaac atcttacaat aaacagtaca agaagtggtg gacagtcgct ccattcttca     600
tcagacacca atatcagtca aataccgttc gaagatgatc taaacgactc ggataacatt     660
tttatagaca agttatacac cttacccaag ttatccactc ctatcgaaat tgatataaga     720
ataacgaaaa ctgcatcaat acctcatgag cgtcctgagg aacagtcaat attgaaggaa     780
tacacctcgg gtgatattat tcatggttat tgtttaattg aaaatcggtc ctctcaacca     840
ctgaaatttg aaatgtttta tgtcacttta gaagcgtaca tatctgtaat tgaccgtcag     900
aaagggaaaa gaacgttaaa gagattttta agaatggtcg atttgagcgc atcttggtct     960
tatacaaaca taccccaagt tacgggtatt aatattgtcc ccggtgaaag ggattttgac    1020
gatgccatca ttggtctttc aaacagcaga gaattgaagc gaacacaaa gtataagaaa    1080
ttcttcatgt tcaagcttcc tacacagtta ttggacgtga cttgcaaaca agagcaattc    1140
tcacactgcc ttctgcctcc cagctttggt atcgacaagt ataaaataa ttgtaaatac    1200
tctgcataa aagtaaatag tgtccttggc tgtgggcatt taggtacaaa aggttcaccc    1260
attctgacac ttgacatggc agatgataat ttatcaataa attatacaat tgatgccaaa    1320
attgtcggta agataaaag aacatctaag ctgaatatta tgaaagaaaa agaatataac    1380
ttgagagtta tgcccttccc ctttgctggt gtcactaatc aacaaacga gaaacgtgt    1440
ttgagacaac tgaaaaattt ggaaagcttg attgaagata gatttgaagc tttgaacaag    1500
attttcaaga aactggaatt aaatgaggcc atttcgaatg tagatattca tgacacagat    1560
ataagcggga ctttggacgg taatgaagat ttggattccg atgagatatt aagacgtaag    1620
ctagatcaac tgcacatcaa taacaggatt gatgataccg ccagccaatc accatcctat    1680
gactccaaaa atatggctcc aaaggaaaac ctagtcgaga ctgagttacg ctataagttt    1740
aaaaataaga ataaatcaaa ttcaagttta ttttctcatt ttttgagttc atcagaaacg    1800
gggtcatctt caactggtcc acatgtatat aattccggat tgattgtatt ccagttaaa    1860
aaaccgcaat ctacattacc ttattggtca ccatcattgt tgagaaaaac caacaaattt    1920
gaagcaaaga gtgaacaaga aaggaaaac tggcaaaggt taatgggcat gcttccagaa    1980
ggagtgaaaa ccccactgac caagttagat gtacatttga cttgtatcca atctaataat    2040
agtgcaggac ataagccgcc agaaataagc tctgtaacga cagaatttgt ggtcatcaca    2100
gcaaagtctg ataattcgat tcctatcaaa ttctgcactg aactgttgat gaatgagaat    2160
agattaaaca aactaaagac aaaatttttg acgtatcaga aaaagttca tgaatatcgt    2220
aaaaaatttg aagaaaacca tgcgaagcta aacgagcttt ataatagaaa tagagatcat    2280
ttcactccaa aagagctttt gttcacaaat ttcatatctg atcaaataaa caatgatatt    2340
gacagtttag ctggattaaa agttaacatt attgatttac atgatatctt caaaaagcaa    2400
atacatactt ttgaagaaga aaacgaggat attatttcga agaaaggaag ttccaatcct    2460
ccttccgcgt catccagtaa taataatttc ttacaagcaa catttagcaa tggtgcatcc    2520
accgctacta agtttactca gcaaattgtg catgaatggg aaaaagttaa gccattacag    2580
tataagaggg atgttacagt taatttgaag ctcaaccccca acattaaaga aacgttagtg    2640
cccaatcttg aaacgtgttt gtgttgtaga ttttattgtg ttcgagtaaa catcaaattt    2700
gataaccact gggttctat gaaagttgat attccggttg atgtgaaaaa gttacaaatt    2760
tag                                                                   2763

SEQ ID NO: 48
MTFTFSTSSR KNGRPPLKSV STEDNIHLLR KRRQQQLSSN STDNSLHPNS GQTPRASDSQ      60
DDDIRSASTT NLDRLRQERE ENSLEMDCTQ SRLSHRANML VDVLPSFEMY NALHRHIPQG     120
NVDPDRHDFP PSYQEVRTQR MTILPSNDNS VERSQLTAVP GSENACNNAT AHSLTNLHPL     180
QTQHLTINST RSGGQSLHSS SDTNISQIPF EDDLNDSDNI FIDKLYTLPK LSTPIEIDIR     240
ITKTASIPHE RPEEQSILKE YTSGDIIHGY CLIENRSSQP LKFEMFYVTL EAYISVIDRQ     300
KGKRTLKRFL RMVDLSASWS YTNITPSTGI NIVPGERDFD DAIIGLSNSR ELKPNTKYKK     360
FFMFKLPTQL LDVTCKQEQF SHCLLPPSFG IDKYKNNCKY SGIKVNSVLG CGHLGTKGSP     420
ILTLDMADDN LSINYTIDAK IVGKDKRTSK LNIMKEKEYN LRVMPFPFAG VTNQQNEKTC     480
LRQLKNLESL IEDRFEALNK IFKKLELNEA ISNVDIHDTD ISGTLDGNED LDSDEILRRK     540
LDQLHINNRI DDTASQSPSY DSKNMAPKEN LVETELRYKF KNKNKSNSSL FSHFLSSSET     600
GSSSTGPHVY NSGLIVLSVK KPQSTLPYWS PSLLRKTNKF EAKSEQEKEN WQRLMGMLPE     660
GVKTPLTKLD VHLTCIQSNN SAGHKPPEIS SVTTEFVVIT AKSDNSIPIK FCTELLMNEN     720
RLNKLKTKFL TYQKKVHEYR KKFEENHAKL NELYNRNRDH FTPKELLFTN FISDQINNDI     780
DSLAGLKVNI IDLHDIFKKQ IHTFEEENED IISKKGSSNP PSASSSNNNF LQATFSNGAS     840
TATKFTQQIV HEWEKVKPLQ YKRDVTVNLK LNPNIKETLV PNLETCLCCR FYCVRVNIKF     900
DNHLGSMKVD IPVDVKKLQI                                                  920

SEQ ID NO: 49
atgcaagccc aaggttcaca atcgaatgta gggtctttga ggagtaattg ctctgacaat      60
tcactaccga acaatcatgt tatgatgcac tgcgatgaaa gcagcggcag cccgcacagc     120
gagcacaacg attatagtta cgaaaagacc aatctgaaaa gtacggcatc aaatagtcgt     180
gaacagagag acaaccagct aagtaggttg aagagtgagg aatacgttgt tccaaagaat     240
caacgtaggg gactattgcc tcaactcgcc attataccgg agttcaagga tgccagagat     300
tatccaccga tgatgaaaaa gatgattgtc tccttgattg cgttttcctc catgatgggc     360
cccatgggca catctatcat ttttccagcg atcaactcaa tcacaacaga atttaaaaca     420
tcagtgatta tggtaaacgt ttcaattggt gtgtaccttt aagtcttgg tgttttccca     480
ttgtggtggt cttctctatc cgagctagag ggcagaagaa ctacttacat aacttcattt     540
```

TABLE 3-continued

Sequences disclosed herein.

```
gcattattgt ttgcatttaa tatcgggtct gctctagctc ctgatatcaa ctcatttatt     600
gccttgagaa tgctctgtgg ggctgcttct gccagtgttc aaagtgtagg tgctggaaca     660
gtggctgatt tatatattag cgaagataga ggtaaaaatt tgagttatta ctatttgggt     720
ccactactgg cgccgctact atctccaatt tttggatctt tgttagtgaa tcgctggccc     780
tggagatcca ctcaatggtt tatggttatt ttatccggat gtaatgtcat tctttttgacg    840
gtgttactac ctgaaacatt aagaaaacaa gattctaaag cgctatcgc tcaaattttg      900
gctgaaagac gtattcaagt agacaataac gaacgtggag agatacaaga agattatcag     960
aggggagaag atgagacaga tcgaattgaa aaccaagttg ccacattatc tactgagaag    1020
cataactacg ttggagaggt aagggatcaa gactcgctag atttagaaag tcactctagc    1080
cccaatactt atgatggtcg agctggagaa acccaattgc aacggattta tacagaggcg    1140
agtagaagtc tgtatgaata tcagctagat gatagcgcta tcgatgcaac aacagcacaa    1200
gttacgagaa taagatcaac agatccaaag ttagcgagat cgattcgaga aaatagtctg    1260
agaaaattac aaaccaacct ggaagagcaa gtcaaaaaag tgctatccag taatggaggt    1320
gaaatcgctc taaacaggt atcagcggtg aggaaggtct gggacacctt ttttgtttat     1380
tttatcaagc ctttaaaatc attgcacttc ctagaataat cacccgtggc acttgcaata    1440
acattttccg caatttcctt ttccacagta tactttgtta atatgacagt tgaatataaa    1500
tattcaaggc ctccttacaa cttttaaacca ttatacattg gtctactgta tattccgaat   1560
tctgtaacat acttttttcgc ctcaatttac ggtggacgtt gggtggacat gcttttaaaa   1620
agatacaaag agaaatatgg aattcttgct cctgaagctc gtatatcgtg agatttgtt    1680
acatctgtaa tatctttccc cattgcgcta ttgatatttg gctggtgcct agataaaaaa    1740
tgccactggg taacgccact aattggaaca gccctctttg gatatgcagc tatgatgaca    1800
attggtgcta ccctttccta tttagtcgat tcattgccgg gaaagggtgc caccggtgtt    1860
gctttgaata atttaataag gcaaatcttg gctgcaaccg cagtctttgt caccacaccc    1920
atgttaaacg gtatgggaac tgggtgggct ttcacaatgc tggcctttat cgtcttgggt    1980
gctagcagtg tacttataat actgaaaaag cacggtgatt actggagaga gaactacgat    2040
ttacaaaaat tgtacgacaa aattgattaa                                     2070

SEQ ID NO: 50
MQAQGSQSNV GSLRSNCSDN SLPNNHVMMH CDESSGSPHS EHNDYSYEKT NLESTASNSR      60
EHRDNQLSRL KSEEYVVPKN QRRGLLPQLA IIPEFKDARD YPPMMKKMIV FLIAFSSMMG    120
PMGTSIIFPA INSITTEFKT SVIMVNVSIG VYLLSLGVFP LWWSSLSELE GRRTTYITSF    180
ALLFAFNIGS ALAPDINSFI ALRMLCGAAS ASVQSVGAGT VADLYISEDR GKNLSYYYLG    240
PLLAPLLSPI FGSLLVNRWP WRSTQWFMVI LSGCNVILLT VLLPETLRKQ DSKGAIAQIL    300
AERRIQVDNN ERGEIQEDYQ RGEDETDRIE NQVATLSTEK HNYVGEVRDQ DSLDLESHSS    360
PNTYDGRAGE TQLQRIYTEA SRSLYEYQLD DSGIDATTAQ VTRIRSTDPK LARSIRENSL    420
RKLQTNLEEQ VKKVLSSNGG EIAPKQVSAV RKVWDTFFVY FIKPLKSLHF LEYPPVALAI    480
TFSAISFSTV YFVNMTVEYK YSRPPYNFKP LYIGLLYIPN SVTYFFASIY GGRWVDMLLK    540
RYKEKYGILA PEARISWNVV TSVISFPIAL LIFGWCLDKK CHWVTPLIGT ALFGYAAMMT    600
IGATLSYLVD SLPGKGATGV ALNNLIRQIL AATAVFVTTP MLNGMGTGWA FTMLAFIVLG    660
ASSVLIILKK HGDYWRENYD LQKLYDKID                                      689

SEQ ID NO: 51
atgactgaat tgtgtcctgt ctacgcccct ttctttggtg ccattggttg tgcctctgca     60
attatcttca cctcattagg tgctgcttac ggtactgcta agtcggtagt tggtatctgt    120
gccacttgtg tgttgagacc agacctatta ttcaagaaca ttgttcctgt tattatggct    180
ggtatcattg ccatttacgg tttagttgtt tccgttttgg tttgttattc gttgggtcaa    240
aagcaagctt tgtacaccgg tttcatccaa ttgggtgccg gtctatcagt cggtttgagt    300
ggtctagctg ctggtttcgc tattggtatt gtcggtgatg caggtgttag aggttcctct    360
caacaaccaa gattattcgt cggtatgatt ttgattttga ttttttgctga gttttgggt    420
ctatacggtt tgattgttgc tttgttgttg aactccaggg ctactcaaga tgttgtctgt    480
taa                                                                  483

SEQ ID NO: 52
MTELCPVYAP FFGAIGCASA IIFTSLGAAY GTAKSGVGIC ATCVLRPDLL FKNIVPVIMA     60
GIIAIYGLVV SVLVCYSLGQ KQALYTGFIQ LGAGLSVGLS GLAAGFAIGI VGDAGVRGSS   120
QQPRLFVGMI LILIFAEVLG LYGLIVALLL NSRATQDVVC                         160

SEQ ID NO: 53
atgacaaggt tcatgaacag ctttgccaaa caaacgctgg gatatggcaa atggcgaca      60
gtggagcaag agagctcagc tcaggctgtt gattctcatt caaacaacac accgaagcaa    120
gctaaggtg ttcttgcaga ggaactaaag gatgcattgc ggttccggga cgaaagagtt     180
agtattatta tgcagagcc ttcttcaaca ctgttcgtct tttggttttgt ggtttcatgc    240
tatttccctg tgattactgc ctgctttggg cccgtagcta acactatctc gatagcctgt    300
gtagttgaaa atggagatc cttaaagaac aactccgtgt tgacaaatcc acgaagcaat    360
gacaccgtg ttttgatgaa tcaagtaaag acagttttttg atcctcctgg tattttttgcc    420
gttaatatca tctctcttggt actgggtttt acgtcaaata ttatactaat gctacatttc    480
agtaagaagt tgacgtatct taaatctcag ttaataaaata taacaggatg gacaatagct    540
ggagggatgc ttttggtgga cgtgattgta tgctccttga tgacatgcc cagcatctac    600
agtaagacta tcggattttg gtttgcctgt atcagttcgt gtctatattt ggtatgcacc    660
attatttaa caatacattt tattggatat aaattaggaa aatatcctcc aacgttcaac   720
cttttgccca atgaaagaag tatcatggca tacactgtac tattgtcttt atggttgatt   780
tggggtgcgg gtatgtttag cggttattg cacatcactt acgaaatgc attatatttc     840
tgcacgtat cattattaac cgtgggacta ggtgacatcc tgcccaagtc ggttggcgcc    900
aaatcatgg ttttaatctt ttcgctatct ggtgttgtct tgatgggttt aatagtgttt    960
atgacaagat ccatcattca aaagtcctct ggcccaattt tcttttttcca cagagttgaa   1020
aaaggcaggt ccaaatcgtg gaaacattat atggatagta gtaaaaattt atctgaaagg    1080
gaagcgttcg acttaatgaa gtgtatccga caaacggcct caaggaagca gcattggttt    1140
tctttgtcgg tgactattgc aatttttcatg gcttttttggt tattgggagc tcttgtattc    1200
```

TABLE 3-continued

Sequences disclosed herein.

```
aaattcgcag aaaattggtc gtacttcaat tgtatttact tttgtttctt gtgcttatta    1260
accattggat acggagacta tgctccaagg actggtgcag gccgtgcttt ttttgtgatt    1320
tgggcgttgg gagccgtgcc attaatgggg gctatcctat ctacagtcgg tgatctgttg    1380
tttgacattt ccacttctct ggatattaag atcggtgaat cattcaataa taaagtcaag    1440
tccatcgttt ttaatgggcg tcaaagagca ctttcctta tggtgaacac tggagaaatt    1500
ttcgaagaat ctgacacagc tgatggtgat ctggaagaaa atacaacgag ctcacaatcc    1560
agtcaaattt ctgaattcaa cgataataat tcagaagaga atgattctgg agtgacatcc    1620
cctcctgcaa gcctgcaaga atcattttct tcattatcaa aagcatctag cccagaggga    1680
atacttcctc tagaatatgt ttcttctgct gaatatgcac tacaggactc ggggacctgt    1740
aatttaagga acttgcaaga gctacttaaa gccgtcaaaa aactcatcg gatatgtctg    1800
gcggataaag attacacact tagttttttcc gactggtcgt acattcataa actacatttg    1860
aggaacatta cagatattga ggagtacaca cgcggacccg aattttggat atcacctgat    1920
acgcccctca agttcccgtt aaatgaacct cattttgctt ttatgatgct tttcaagaac    1980
atagaagaat tagttggtaa tctagtagaa gacgaagagc tttataaagt tataagcaaa    2040
agaaaattt gggtgagca tagaaagaca ctttga                               2076
```

SEQ ID NO: 54
```
MTRFMNSFAK QTLGYGNMAT VEQESSAQAV DSHSNNTPKQ AKGVLAEELK DALRFRDERV     60
SIINAEPSST LFVFWFVVSC YFPVITACLG PVANTISIAC VVEKWRSLKN NSVVTNPRSN    120
DTDVLMNQVK TVFDPPGIFA VNIISLVLGF TSNIILMLHF SKKLTYLKSQ LINITGWTIA    180
GGMLLVDVIV CSLNDMPSIY SKTIGFWFAC ISSGLYLVCT IILTIHFIGY KLGKYPPTFN    240
LLPNERSIMA YTVLLSLWLI WGAGMFSGLL HITYGNALYF CTVSLLTVGL GDILPKSVGA    300
KIMVLIFSLS GVVLMGLIVF MTRSIIQKSS GPIFFFHRVE KGRSKSWKHY MDSSKNLSER    360
EAFDLMKCIR QTASRKQHWF SLSVTIAIFM AFWLLGALVF KFAENWSYFN CIYFCFLCLL    420
TIGYGDYAPR TGAGRAFFVI WALGAVPLMG AILSTVGDLL FDISTSLDIK IGESFNNKVK    480
SIVFNGRQRA LSFMVNTGEI FEESDTADGD LEENTTSSQS SQISEFNDNN SEENDSGVTS    540
PPASLQESFS SLSKASSPEG ILPLEYVSSA EYALQDSGTC NLRNLQELLK AVKKLHRICL    600
ADKDYTLSFS DWSYIHKLHL RNITDIEEYT RGPEFWISPD TPLKFPLNEP HFAFMMLFKN    660
IEELVGNLVE DEELYKVISK RKFLGEHRKT L                                   691
```

SEQ ID NO: 55
```
atggactggg caatcaatgt cgcccatcca cgattacttt acaaggatcc taaactttca     60
gtaacgttta ttgtgccgag cttatttcat atcattattg ctttcgtgtt attaggaata    120
tgtgcatccg attttctttg ccccaacgtg gcccatatat cagatcccaa cagccttcga    180
tcgaatggtt ctttagtctc aaaaacggcg tcccatgcat ctcatactgg ggcattaatg    240
gcagttctac tatcttggtg taactcttcg cctgacctat tttccaactt aatgagctgg    300
gcaacctcta cgagagaaac aaggtcaacc tcagtatcgc tatcaattgg tgaggtgctt    360
ggcgcttgcg gcattatcct gtgcattgta gagggctcca ttttttattat tatgtcaaga    420
actcacattg aaatctcgca aattcaaaaa ctatccatca tgagagactt gttatttct     480
ttagctgcca tgtgcgtaat gagttacgtt tcccttatga atcaggtcac tgtgctgaat    540
tgccttttga tggcgttcct ttatgccttt tatctagtcg ttaagttaac tttcaagctt    600
aatcattctg cagaaacccc agatgaaact gctgcggata cgagcctcag agaaactcc     660
gtttctcctt tttttgatga ctctctgatg gcttctggtt tactaccacc aatacaacct    720
ggcttgaca tatccaattc tataacacac ggcattaagc ctagtttgct atctgctatg    780
gatttcaata gtttcttatc aatgcttgaa aactcatctt tggaggagga tgactcaagg    840
aatgaaatgg cagaattgaa cactctacg agcatgacgc cgggacaaca ttggtccgcc    900
tctgcaacag ttgcaggaga ggcaacgagt gctggaagac ctttcagtga gccaacgaat    960
gcgtttacgg aatatagaga ttctgaaaga gcaataaata gttccccagc ggtgttcgcc   1020
ccctaccgtg acaaccctga tgatgaagag tctcaagagc aagtattatt ggagacaaca   1080
acgcatggtc attttggtgc gcaagaaatg cgaaggttct ccaaaaggtc tctgggctgg   1140
attataaaa ttttcatacc acatctctca aatttttccc agaaatccat ctcagatgcg   1200
atcttttcca taatcaactgt tccgtttttc attattttca aactatcatg tcctcaaccg   1260
ccttcagata ttttgagtta tgatcccact ttgaacagat actctttaac aacgttaccc   1320
ataattttat tattatccat atcaattact gcacccttcc tcctttgcag tatactttct   1380
gtgcttttga catatcatct aggctatctc gtttaccttt tccctcttat attagctatg   1440
gccttaattt tactattgac ggcttttatt acaaaggtaa atctgcataa caagtttact   1500
ctgtcattag acagctctaa cattttacag gaaaagctac aaaaaagaaa actcctcgaa   1560
aggcttaaca caagcatcca ataattttt ctagctatcg gcataataaa tatcataatt   1620
tggatatcac ttttagccaa ttctcttatt gagatgatgg aaatttacca aaaaatatta   1680
ggattatcga agctatttt gggccttacc atttttcgcat ggggcaactc agtaggagac   1740
ttgatctcca acatatctat gtgcaggctc tacaaaaccc aaactcacta ccaagacaga   1800
gttcgtttag ccacaaaatt ttttatgata tcatgcgcat cttgcttagg aggcgtaatg   1860
ctgaattcta tgggtggaat aggctttagt gggcagtat caatgctttt tattggcgct   1920
tttaatgata acgaatggtg gttcctaaga aaggttaaat tacaagaaac aagtcaattg   1980
gataatacat taattacaa agtgcattatt tcttgctct tcattatcct acagattatt   2040
ctcttgctgt tattcttcgg agggcctaac aatattaaac ggcgcctcac aaaggagatg   2100
aagttagtcg gaatctctat gtgcggacta tgggcactag ccacgttgat taatatactt   2160
ctagaactgt ttagctaa                                                 2178
```

SEQ ID NO: 56
```
MDWAINVAHP RLLYKDPKLS VTFIVPSLFH IIIAFVLLGI CASDFLCPNV AHISDPNSLR     60
SNGSLVSKTA SHASHTGALM AVLLSWCNSS PDLFSNLMSW ATSTRETRST SVSLSIGEVL    120
GACGIILCIV EGSIFIIMSR THIEISQIQK LSIMRDLLFS LAAMCVMSYV SLMNQVTVLN    180
CLLMAFLYAF YLVVKLTFKL NHSAETPDET AADTSLRENS VSPFLDDSLM ASGLLPPIQP    240
GFDISNSITH GIKPSLLSAM DFNSPLSMLE NSSLEEDDSR NEMAELNTLR SMTPGQHWSA    300
SATVAGEATS AGRPFSEPTN AFTEYRDSER AINSSPAVFA PYRDNPDDEE SQEQVLLETT    360
THGHFGAQEM RRFSKRSLGW IIKIFIPHLS NFSQKSISDA IFSIITVPFF IIFKLSCPQP    420
PSDILSYDPT LNRYSLTTLP IILLFIQSIT APFLLCSILS VLLTYHLGYL VYLFPLILAM    480
```

TABLE 3-continued

Sequences disclosed herein.

```
ALILLLTAFI TKVNLHNKFT LSLDSSNILQ EKLQKRKLLE RLNTSIQIIF LAIGIINIII   540
WISLLANSLI EMMEIYQKIL GLSKAILGLT IFAWGNSVGD LISNISMCRL YKTQTHYQDR   600
VRLATKFFMI SCASCLGGVM LNSMGGIGFS GLVSMLFIGA FNDNEWWFLR KVKLQETSQL   660
DNTLNYKFIV SCVFIILQII LLLLFFGGPN NIKRRLTKEM KLVGISMCGL WALATLINIL   720
LELFS                                                               725

SEQ ID NO: 57
atgaactcat ggaacctgag ttcttcaata ccgataatac atacgcctca tgaccatccc    60
ccgacatcag aaggaactcc agatcaacca aataataacc gaaagatga taaactgcac   120
aaaaaaagag gcgattcaga tgaggactta agccctatat ggcattgtgt cgtctccggt   180
gggattggtg gaaaaatagg agattctgcg atgcattcat tggatactgt taagacaaga   240
caacagggcg cacccaatgt caaaaaatac aggaacatga tctctgcata tcgtaccatt   300
tggctagaag aaggcgtgag aagggggcta tacggcggtt acatggctgc catgttaggc   360
tccttcccgt cagcggcaat cttctttggg acctatgaat atactaagag aacaatgata   420
gaagattggc agattaacga taccatcaca catttgatcg ctggatttct tggcgatttt   480
atctccagtt ttgtttatgt tccatcagag gtcctaaaga caaggctaca attgcaagga   540
aggttcaata atcctttctt tcaatctggc tataattatt cgaatttaag aaatgccata   600
aagacagtta taaagaaga aggggtttcgc tcactatttt ttggatacaa agccactttta  660
gccagagatt tgccatttag tgcattgcag tttgccttct acgaaaagtt taggcaattg   720
gctttcaaga ttgaacagaa agatggtagg gatggtgagt tgtctatacc taatgaaata   780
ttgactggtg cctgtgcagg tggactggcg ggaatcatta ccacaccaat ggatgttgtt   840
aagactagag tccaaactca acagccgccc agccaaagca caaatcata ctcagtaaca    900
catccacatg taacaaacgg cagaccggca gcacttccca actcgatttc gctcagcctt   960
cggacggtct accaatctga aggtgtgtta ggtttcttta gtggcgttgg ccctagattc  1020
gtctggacaa gtgttcagag cagtataatg ttgcttctgt atcaaatgac cctacgcgga  1080
ttaagtaacg catttccaac ggactaa                                      1107

SEQ ID NO: 58
MNSWNLSSSI PIIHTPHDHP PTSEGTPDQP NNNRKDDKLH KKRGDSDEDL SPIWHCVVSG    60
GIGGKIGDSA MHSLDTVKTR QQGAPNVKKY RNMISAYRTI WLEEGVRRGL YGGYMAAMLG   120
SFPSAAIFFG TYEYTKRTMI EDWQINDTIT HLSAGFLGDF ISSFVYVPSE VLKTRLQLQG   180
RFNNPFFQSG YNYSNLRNAI KTVIKEEGFR SLFFGYKATL ARDLPFSALQ FAFYEKFRQL   240
AFKIEQKDGR DGELSIPNEI LTGACAGGLA GIIITTPMDVV KTRVQTQQPP SQSNKSYSVT   300
HPHVTNGRPA ALSNSISLSL RTVYQSEGVL GFFSGVGPRF VWTSVQSSIM LLLYQMTLRG   360
LSNAFPTD                                                            368

SEQ ID NO: 59
atgtccgtac aaaaagaaga atacgatatt gtagaaaagg cccaattatc tgtgtccgca    60
gaaagcttaa catcagattc ggagagtatt tcacataacc catttgacga ttttcataaa   120
gcagagcgtt ggagaaaagt ctatgaatcc agtggttatg aaggcttgtc taaattcgat   180
cctgagttta catggacaaa ggatgaggaa aagaaattgg taagaaaaat ggacttgaag   240
atttttttgt gggtttttat tatgtttgcc tttttggatt taataaggaa aaatattgca   300
agggcagttt cagacaactt cattgttgac ttgaaaatga acacgaacga ctacaacctt   360
ggccaaactg tttatctagt tatatttcta gcaagtgaac tacccggcaa tctgctcgtc   420
aaaagatttg gtccagaaag ggtcattccg gttcaaattg tgttgtggag tgtaatttgt   480
attactcaag ctggtctgaa aaatcgaggt caatttattg ctactagatg cttattagga   540
atggtacagg gcggggttcat cccggacaat attctatact tgtcatatta ttatactgga   600
gctgagctca cattccgcct aagtttcttt tggtgtgcta tacctctttt ccaaatttta   660
ggctctctttt tagcttccgg aatcatagag atgaggggta ttcataactt agctggctgg   720
cagtacctat ttataattga aggtttctgt tccctttctg ttgcgtggc atccttttat    780
ttaatgcgta gaggacctac gcaaactggt gagtctgcat tcacaaagg aaaatcgtta   840
ttcactgagt atgaggagaa aattatggtt aacagaattt aagggatga cccatcaaag   900
ggtgacatga gtaaccgaca accagttacc ttcaaggaga ttttgtacac tctaacagaa   960
tttgatctat ggcattgtt tatccaaggt attacagcat tcatatctct tcaaacagtt  1020
ggttcctatt tatctttgat attaaagagt ttaaattact ctacatttct ttcgaacatt  1080
ttagcaattc caggccaagc cctgctgcta ataaatttac cattagcggc actattatcg  1140
cgtaaattga aagaaaatc acttttgtgtg ggaattgcca acgtttgggt gctccctttc   1200
atagtttctc tggtcgcttt accgactgac acaaacccct ggatcaagta tatattacta  1260
accggtatac ttggtcttcc ctatacacat tccattcttg ctggttgggt ctccgagatt  1320
tcaaattcgg taagatcgcg tacagtgggc acagcgttat acaatatgag tgcccaagtt  1380
ggagcaatca ttgcttctaa catgtataga aatgatgata aaccttacta tactagaggt  1440
aacaaaaatac ttctaggatt cacttgcttc aacatttgta tggctgttgc tactaagttt  1500
tactatatta gtaggaataa atacaaggac cgcaaatgga actctatgac aaaagaaag   1560
cagatcaatt acttggacac aactaaagat aagggaatga agcgtcttga ttataggttt  1620
attcactag                                                         1629

SEQ ID NO: 60
MSVQKEEYDI VEKAQLSVSA ESLTSDSESI SHNPFDDFHK AERWRKVYES SGYEGLSKFD    60
PEFTWTKDEE KKLVRKMDLK IFLWVFIMFA FLDLIRKNIA RAVSDNFIVD LKMNTNDYNL   120
GQTVYLVIFL ASELPGNLLS KRFGPERVIP VQIVLWSVIC ITQAGLKNRG QFIATRCLLG   180
MVQGGFIPDN ILYLSYYYTG AELTFRLSPF WCAIPLFQIL GSLLASGIIE MRGIHNLAGW   240
QYLFIIEGFL SLSVGVASFY LMRRGPTQTG ESAFHKGKSL FTEYEEKIMV NRILRDDPSK   300
GDMSNRQPVT PKEILYTLTE FDLWPLFIQG ITAFISLQTV GSYLSLILKS LNYSTFLSNI   360
LAIPGQALLL INLPLAALLS RKLKEKSLCV GIANVWVLPF IVSLVALPTD TNPWIKYILL   420
TGILGLPYTH SILAGWVSEI SNSVRSRTVG TALYNMSAQV GAIIASNMYR NDDKPYYTRG   480
NKILLGFTCF NICMAVATKF YYISRNKYKD RKWNSMTKEE QINYLDTTKD KGMKRLDYRF   540
IH                                                                 542
```

TABLE 3-continued

Sequences disclosed herein.

SEQ ID NO: 61
```
atgtcatctg acaactctaa acaagataaa caaattgaaa aaacagccgc ccagaagata   60
tcgaagtttg gttcgtttgt ggctggtggg ctagcagcat gtatagctgt tacagttact  120
aatccgatcg aattgattaa atcagaatg cagcttcaag gtgaaatgtc agcatcagct  180
gcaaaagttt ataaaaatcc aatccaaggt atggcggtaa ttttcaaaaa cgaaggtata  240
aaaggtctgc aaaaagggtt aaatgctgct tatatctatc aaattgggct aaatggttcc  300
agattagggt tttatgagcc aatcagatca tcattaaatc agcttttctt cccagatcaa  360
gagccacata aggtacagag cgtcggagtt aacgtctttt ctggtgccgc atctggtata  420
attggtgcag tcattggctc tccattattc ttggtgaaaa caagacttca atcatattcc  480
gagtttataa aaattggtga acaaacgcac tacaccggtg tttggaacgg ttagtaacc   540
atttttaaaa ccgaaggtgt taagggtcta ttcagaggta ttgatgcggc aattttaagg  600
acaggtgctg gttcctctgt tcaactacct atctacaaca cagcaaagaa catttttggtc  660
aaaaatgatc tgatgaaaga tggcccagca ttacatttaa ctgctagtac tatctctggg  720
ttaggtgttg ccgtcgttat gaaccatgg gatgtcattt tgacaagaat ctataatcaa  780
aaaggtgact tgtacaaggg acctatagat tgtttggtca aaactgttag aatcgaaggt  840
gtaaccgctt tgtataaggg ttttgcagct caagtgttca gaatcgcacc tcatacaatc  900
atgtgtttga cctcatgga acagacaatg aaactagttt attcgataga gtcgagagtt  960
ttaggccata attaa                                                    975
```

SEQ ID NO: 62
```
MSSDNSKQDK QIEKTAAQKI SKFGSFVAGG LAACIAVTVT NPIELIKIRM QLQGEMSASA   60
AKVYKNPIQG MAVIFKNEGI KGLQKGLNAA YIYQIGLNGS RLGFYEPIRS SLNQLFFPDQ  120
EPHKVQSVGV NVFSGAASGI IGAVIGSPLF LVKTRLQSYS EFIKIGEQTH YTGVWNGLVT  180
IFKTEGVKGL FRGIDAAILR TGAGSSVQLP IYNTAKNILV KNDLMKDGPA LHLTASTISG  240
LGVAVVMNPW DVILTRIYNQ KGDLYKGPID CLVKTVRIEG VTALYKGFAA QVFRIAPHTI  300
MCLTFMEQTM KLVYSIESRV LGHN                                          324
```

SEQ ID NO: 63
```
atgctatctt cagaagattt tggatcttct gggaaaaagg aaacttctcc tgattcgata   60
tcgatacgtt cctttagtgc cgggaataat ttccaatcat catcaagtga aaaacttat   120
tctaagcaaa aatccgggag tgacaaactt atacatagat ttgcggattc attcaaaaga  180
gccgagggta gcactacaag aactaagcaa ataaatgaaa atacgtctga tttagaggat  240
ggcgttgagt ctatcacgtc ggattccaag ttgaaaaagt ccatgaagtc gcgccatgtt  300
gtcatgatgt ctttagggac aggtattggg actggtcttt ggtagctaa tgcaaaaggt  360
ctacattacg gtggtcctgc tgcgctaata attggttaca tcttggtttc tttcgtgacg  420
tacttcatga tccaagcctgc aggtgagatg gcggtaaact atccgacttt accagccaat  480
ttcaacgcat actcctccat attcatttcc aaatcatttg gattcgccac agtatgcctt  540
tactgtttcc aatggctaac ggttttgcct ttagagttaa taccgcgtc tatgactatt  600
caattttgga atgataaaat aaatccggac atttatattc ttatttttcta tgttttctta  660
gtattcattc atttcttcgg tgtaaaagcc tatggtgaaa cggaattcat cttcaattgc  720
tgtaaaattt taatgattgc aggtttcatt attcttccta ttgttatcaa ctgtggtggg  780
gccggaaatg acggttatat cggggccact tattggcata atccaggtgc ttttgcaggt  840
gacacatcga ttggtaggtt caaaaacgtt tgctatattt tagttactgc ttacttctcc  900
tttggtggta tggaattatt tgcactaagt gttcaggaac agtctaaccc tagaaaatct  960
actccggtgg cagccaagag aagcatttat cgtatcgttg tgatttatct tttgactatg 1020
atcctcattg gattcaatgt tccatataat gatgaccaac taatgggcgc aggcggatcc 1080
gctacacatg catctccccta tgtcttagcc gcttctattc acgtgtgaa aattgttcca  1140
catattatca acgctgttat ttgatttctt gtggtttcag tggcaaattc ctcttttgat 1200
gctggtccaa gactgatttg ctcttttggcc caacaaggct acgcacccaa gtttttagat 1260
tacgttgaca gagagggcag gccccttgaga gctcttattg tgtgttgcgt tttcggcgtc 1320
attgcttttg ttgcagcttc atcaaaggaa gagatcgtgt tacatggtt agcagctatc 1380
gcaggcttga gtgaattatt cacatggact tccataatgt tgtcccatct gcgattcaga 1440
caagcaatga aagtacaggg aaggtctcta gacgagttgg gatacaaggc cacaacaggg 1500
atttgggggtt ccatatacgg tgtcttttttt aatattttag tctttgttgc ccaattttgg 1560
gtagcattgg cccccttagg taatgggggc aaatgcgatg cggaatcctt ctttcaaaat 1620
tatttagctt ttccaatatg gttggccttt tacttcggat atatggttta caaccgtgat 1680
tttacgctat taaatcccct cgacaagatt gaccttgact tccacagacg catttatgat 1740
ccagagctaa tgagacaaga ggacgaagaa aataaagaaa aactaaggaa tatgtctttg 1800
atgagaaaag cttatcattt ctggtgttaa                                   1830
```

SEQ ID NO: 64
```
MLSSEDFGSS GKKETSPDSI SIRSFSAGNN FQSSSSEKTY SKQKSGSDKL IHRFADSFKR   60
AEGSTTRTKQ INENTSDLED GVESITSDSK LKKSMKSRHV VMMSLGTGIG TGLLVANAKG  120
LHYGGPAALI IGYILVSFVT YFMIQAAGEM AVTYPTLPAN FNAYSSIFIS KSFGFATVWL  180
YCFQWLTVLP LELITASMTI QFWNDKINPD IYILIFYVFL VFIHFFGVKA YGETEFIFNC  240
CKILMIAGFI ILSIVINCGG AGNDGYIGAT YWHNPGAFAG DTSIGRFKNV CYILVTAYFS  300
FGGMELFALS VQEQSNPRKS TPVAAKRSIY RIVVIYLLTM ILIGFNVPYN DDQLMGAGGS  360
ATHASPYVLA ASIHGVKIVP HIINAVILIS VVSVANSSLY AGPRLICSLA QQGYAPKFLD  420
YVDREGRPLR ALIVCCVFGV IAFVAASSKE EIVFTWLAAI AGLSELFTWT SIMLSHLRFR  480
QAMKVQGRSL DELGYKATTG IWGSIYGVFF NILVFVAQFW VALAPLGNGG KCDAESFFQN  540
YLAFPIWLAF YFGYMVYNRD FTLLNPLDKI DLDFHRRIYD PELMRQEDEE NKEKLRNMSL  600
MRKAYHFWC                                                            609
```

SEQ ID NO: 65
```
atggaaccta agcgaaagag cgggtcacta gccaagcatg atttgccgca attttatctt   60
ttaattatgt tatatttggc tcaaggcata cctgtaggat ggccttcgg taccgtaccg   120
tttctactga aatcttagc aaaggagacc tcgtttacat cactgggaat tttctctatg  180
gctacatatc catattcttt aaagatcata tggtcaccaa tagtagactc actgtacaac  240
```

TABLE 3-continued

Sequences disclosed herein.

```
aagcgcatcg gtagaagaag atcatggatc attccagtac aatttgttag tggatttgtg    300
ctatgggcat tagggtggtg catatcacaa ggcataatct tcgatggtgt cgacgatgcg    360
ttccataatc gcggtaatgg cactttacac agtgtcagta taaaaaattt gacgtggtgg    420
tttggcctgt tagttttttct gtgtgccact caagacatcg cagttgatgg ttgggcgttg    480
acgattttgt ccaaagaatc cctatcatat gcatctaccg cgcaaacaat aggttttgaat   540
attggttatt ttatgtcatt taccattttc ctgtcgttga attcctctga tttcgccaat    600
aagtatttca gaaacatccc actggatcac gggttcatta gtcttggtgg gtacatgaaa    660
ttctcgggca tgctttacat tgtaataacc atatatatca tcttttgcac caaggaaaaa    720
ccctacgtag agtatttgcc caaagtggag cccataaata caagtgacgg agggtcaaag    780
ccgataagta ttgagtatga cgacggtgat gtggtgtcaa ctcagaatac aagcagtata    840
aagtacatt  accgctgctt tataaaagtg ttgaaattga agtccgtaag aagcctagcc    900
ttcattcaca tgatttcgaa atttgccttt caatgcaacg aagccgccac aaacctgaaa    960
ctactagagc aaggcttcaa aagagaagac ttggctgtga cagtactcat agacctgccg   1020
ttcgaaatca tatttgggta ctatgttgtt aaatggagct ccgacaagga ccccatgatt   1080
cgtgacaata gaagattaag aaacagcacg ggcaccaaca aggtcatcaa gttcttagtt   1140
ggggatgccg gcgttttaac accatggttg tggggctttt tggccgtct ggcagccgcg    1200
gtcttgggaa gttacgtggt gaagcaattc cccaaggatg gtgaaatatc cacgggttat   1260
ttttgtctcg tgatattcca gcacctctta ggttccttca tgaatactgt ccagttcatt   1320
ggaatatcgg ccttccatac aagagttgca gaccccgtgc tgggtggcac atatatgaca   1380
ttgttaaata ccctcagcaa cttcggtggg acatggccgc ggttaatcat tatgtccatg   1440
atcaactact tcaccgtgta tcagtgcact attcctggca caaataaagt atacgtaact   1500
cacggcggca gcatgcaagc gtgcaccgag cttttgaatg gcaccgtgac catcctgcgt   1560
gacggctatt acatcaccaa tctcatatgt attgtagtcg gacttttcct atattttgga   1620
tatttgaaaa ggaaaatcct ccatttacaa agtctgccaa tcagttcctg gagatgtacg   1680
taa                                                                1683

SEQ ID NO: 66
MEPKRKSGSL AKHDLPQFYL LIMLYLAQGI PVGLAFGTVP FLLKSLAKET SFTSLGIFSM    60
ATYPYSLKII WSPIVDSLYN KRIGRRRSWI IPVQFVSGFV LWALGWCISQ GIIFDGVDDA   120
FHNRGNGTLH SVSIKNLTWW FGLLVFLCAT QDIAVDGWAL TILSKESLSY ASTAQTIGLN   180
IGYFMSFTIF LSLNSSDFAN KYFRNIPLDH GFISLGYMK  FSGMLYIVIT IYIIFCTKEK   240
PYVEYLPKVE PINTSDGGSK PISIEYDDGI VVSTQNTSSI KYIYRCFIKV LKLKSVRSLA   300
FIHMISKFAF QCNEAATNLK LLEQGFKRED LAVTVLIDLP FEIIFGYYVV KWSSDKDPMI   360
RDNRRLRNST GTNKVIKFLV GDAGVLTPWL WGFLGRLAAA VLGSYVVKQF PKDGEISTGY   420
FCLVIFQHLL GSFMNTVQFI GISAFHTRVA DPVLGGTYMT LLNTLSNFGG TWPRLIIMSM   480
INYFTVYQCT IPGTNKVYVT HGGSMQACTE LLNGTVTILR DGYYITNLIC IVVGLFLYFG   540
YLKRKILHLQ SLPISSWRCT                                              560

SEQ ID NO: 67
atggttagta ggtttttatca gattccaggt acgcatcggc catcgtcggc aatatcttct     60
tcaaatgaat cttcttcact gttgtctgca aggagaataa gtcaaacata ttcaattat    120
caggcgaccc ctgaatgcca aaaagtttcc tctaagtatg atcctgataa cccaaacaaa    180
gataagttgg gaacatacga tggggtattt gtgcctactg ctttaaacgt attgtctatc    240
cttatgtttc ttcgttttgg cttcattttg ggtcagttga gtattatatg caccatcggt    300
cttctgctat tgagttacac tattaatctt ctcaccacgt taagtatatc tgctatatct    360
acaaacggga ctgttagggg cggggtgct  tattatatga tttcaagaag tttaggacct    420
gaatttggtg gatccattgg gcttgtcttt ttcttagggc aggtgttcaa tgcaggtatg    480
aacgcagtgg gtattatcga acctttactc tataacttgg gttattctgc tcaaggcgag    540
ccacctgcag ctttgggaga gctactacca agagggcatt ggcacgaatt tacatatgcc    600
acggtcattc ttttcttatg ttttttctgtg gcttttgttg gctcgcaaac agtgtcaaga    660
gcagggaata ttcttttttt  ggtactggca gcttctatat tttccattcc actttctgca    720
ttgataagat cgccattcac tgaaggcggt atcagttata caggtccttc atggcaaact    780
tttcatgata acctgctccc tcacttaaca aaaggtgcag caggttcgtt actcaaaggt    840
aaggaaacat tcaatgattt atttggcgtt ttttttcctg ctacagctgg tatattcgcg    900
ggcgcaggaa tgtcaagtga attgagaaag ccctctaaat caattcctaa gggtacctta    960
tggggtttac ttttcacttt tatctgttat gccgttgttg tcttctccat gggttgttcc   1020
attccagaa  gatcgttata tgatgaagta caaattatac agacgatcag ttccttcag   1080
tgggttatat tcatgggtga aatgctact  tctctttctt ccatcatagt ggggatgctc   1140
ggtgctgctt atgtattaga agcaattgca aaggataaca ttattcctgg tttggagatt   1200
tttgctcatt caccgttata ttcattgatt tttacttgga ttcaacaca  gctatgtttg   1260
ttttcagacg tcaataaaat cgccacattt atcacaatga cattcttaat gacgtttgtg   1320
gtcatgaatt tggcgtgctt cctattaggt atttcctctg ctcccaattt caggccctct   1380
ttcaaatact ttaacaggta tactacagca attggcgcat tactttctgt tgttgcgatg   1440
ttaatagttg atggcatctc agcgtctgtc ttgttttttgg ctatgatttt gctatttta    1500
ttcattcatt atttttcacc accgaagtct tgggtgatg  tgtctcaaag tttaatatat   1560
catcaagtga gaaagtattt gcttcgccta cgtcaagaca atattaaata ctggaggcct   1620
caaatattgc tgtttgtaga taatccaagg acgagctgga acttaataag gttttgcaat   1680
catttgaaaa aaggtggttt gtatattta  ggccatgttg cagtaactgc ggattttccg   1740
aagcaactaa atgaattaaa aactcagcag aaagcttgga tgaagatcag agacatggca   1800
gcaataaagg cttttgtcca agtggggact ggtccctccc ttatatgggg aattaggaat   1860
gttttattg  gttccgggct tggaggtatg aaaccaaaca ttactgttgt cggttttttt    1920
gacctcgaaa gttatagaaa gcacatccca caaagtcgca gccaaaataa ccttcagaaa   1980
caggtgaaa  taaagctac  agtgccacgt agtacatgct ctgatgtcaa aatcaatgtt   2040
ccattgccta cggatgagtg taaaaatgaa accaaagtta atgtacaaca atggggttcaa   2100
attgtagaag atctatcact gatgcaatcc aatattgcca tagcgcatgg attcaaaaat   2160
ttagagatac cgaacaaaag ggacagctgc tttccaaaaa aaactataga tctttatccc   2220
atccaaatgt gcggaaaagt tgaggcaaag ggtgaccagc ctgcggctat cactactaac   2280
tttgatacgt atacactgat tctacaatta gctgccattt tggttactgt tcctgaatgg   2340
```

TABLE 3-continued

Sequences disclosed herein.

```
aagcgcacac attcgcttcg agttatttta tttgtggaac aagaatatca tagaacgaac 2400
gaaactcaac gaatgaaaaa gctattacag gttctaagaa ttgacgcaga ggttttggta 2460
gtatctttag atcaattcag agtatacaac acaattgtca agggagaccc aatcgtgttg 2520
gattatgtca actcgaaatt ggccgataat gaatggtgga aagatttggt tgaagctcgt 2580
gatacattaa aaccgaagcg gaggttttcc actattgaac ctcaaacgat agcaaagcaa 2640
tttacacaat caagaaaata tacgtctggg gttcagaaat tgggtgtctc atttacaatg 2700
aatacgagaa tgccaactaa ccgcattgat accccatgcg agagtgagga ctccgatttg 2760
gatacagatc ttacgtcaat tcgtgatgcc ttctcggcat cgactaatat ttcagtaggt 2820
aaggacttaa cgaccaaatc gaagaccggt tccgacagaa caaatttact cgtaaagaat 2880
ttacaaagcg atgtgtcaac acagtcgtta agacccgttt tctcgagtaa tactttgccg 2940
aggacgagag tcgtggaaga cggtacgggt gaacagccga cactgatccc aattgccgaa 3000
cctgaccttt cgaatgggaa cggtactggg agcggtattg gcaacggcaa caaattaaag 3060
aaaccggttc ttcccgaatt atcaccttgt tgttcaaaag atagtttagt cacagcgatg 3120
caaaatttag gtttcaatga tcttcccagc actgctcaac atttggttct gaatgatgtg 3180
atgacacaaa tgtcaaagag ttcggattta attttttcaa ccttgccagt tccagctctt 3240
ggaacacatg aagatcacga tgcaagttta caatatgtcg aggacttaga tatttggttg 3300
gagggcttac ctccatgcat gttaatcaat tcgcaaacca tgacagtaac tactgcatta 3360
tag                                                                3363

SEQ ID NO: 68
MVSRFYQIPG THRPSSAISS SNESSSLLSA RRISQTYFNY QATPECQKVS SKYDPDNPNK   60
DKLGTYDGVF VPTALNVLSI LMFLRFGFIL GQLGIICTIG LLLLSYTINL LTTLSISAIS  120
TNGTVRGGGA YYMISRSLGP EFGGSIGLVF FLGQVFNAGM NAVGIIEPLL YNLGYSAQGE  180
PPAALGELLP RGHWHEFTYA TVILFLCFSV AFVGSQTVSR AGNILFLVLA ASIFSIPLSA  240
LIRSPFTEGG ISYTGPSWQT FHDNLLPHLT KGAAGSLLKG KETFNDLFGV FFPATAGIFA  300
GAGMSSELRK PSKSIPKGTL WGLLFTFICY AVVVFSMGCS IPRRSLYDEV QIIQTISSVQ  360
WVIFMGEMAT SLFSIIVGML GAAYVLEAIA KDNIIPGLEI FAHSPLYSLI FTWILTQLCL  420
FSDVNKIATF ITMTFLMTFV VMNLACFLLG ISSAPNFRPS FKYFNRYTTA IGALLSVVAM  480
LIVDGISASV LFLAMILLFL FIHYFSPPKS WGDVSQSLIY HQVRKYLLRL RQDNIKYWRP  540
QILLFVDNPR TSWNLIRFCN HLKKGGLYIL GHVAVTADFP KQLNELKTQQ KAWMKIRDMA  600
AIKAFVQVGT GPSLIWGIRN VFIGSGLGGM KPNITVVGFF DLESYRKHIP QSRSQNNLQK  660
QVEIKATVPR STCSDVKINV PLPTDECKNE TKVNVQQWVQ IVEDLSLMQS NIAIAHGFKN  720
LEIPNKRDSC FPKKTIDLYP IQMCGKVEAK GDQPAAITTN FDTYTLILQL AAILVTVPEW  780
KRTHSLRVIL FVEQEYHRTN ETQRMKKLLQ VLRIDAEVLV VSLDQFRVYN TIVKGDPIVF  840
DYVNSKLADN EWWKDLVEAR DTLKPKRRFS TIEPQTIAKQ FTQSRKYTSG VQKLGVSFTM  900
NTRMPTNRID TPCESEDSDL DTDLTSIRDA FSASTNISVG KDLTTKSKTG SDRTNLLVKN  960
LQSDVSTQSL RPVFSSNTLP RTRVVEDGTG EQPTLIPIAE PDLSNGNGTG SGIGNGNKLK 1020
KPVLPELSPC CSKDSLVTAM QNLGFNDLPS TAQHLVLNDV MTQMSKSSDL IFSTLPVPAL 1080
GTHEDHDASL QYVEDLDIWL EGLPPCMLIN SQTMTVTTAL                       1120

SEQ ID NO: 69
atgagtattt caaattggat caccactgcg tatttaatta catcaacatc ttttcaacct   60
ctttatgggt cattttctga tgcacttggt cgaagaaact gccttttctt tgctaatggg  120
gcttttacca ttggatgtct agcctgtggt ttctcgaaaa acatctacat gcttagtttt  180
atgagagcat tgacaggcat aggaggtggt ggcttgatca cactttctac aatcgtaaat  240
tcagacgtta ttccaagttc gaaaagagga attttttcaag cgtttcagaa tttacttttg  300
ggatttggtg ccatatgtgg agcgtctttc ggtggcacaa tagcgtcgag cattggttgg  360
aggtggtgtt ttctcatcca agtacccata tctgtgatta gttccatatt aatgaattat  420
tatgtaccta atcagaaaga atataatcgt caaaattcca gcatattcca aaatcccgaa  480
aaaatactca gggacataga tgttatgggc tcaattctta ttataactgg tctcacacta  540
cagcttcttt acctgagcct ggggtgttct acttctaaat tatcatggac cagcccttct  600
gtgctactgc tattagttgg gagtgtaata atcctcttac tgttcatatt gcacgaaagg  660
aaaacaagtg ctagagcgat tattcctatg gagctggtca attcctccta cagtgtcgtt  720
gtactttcga taagtatact tgttggtttt gccagctacg cgtatctttt tactttacca  780
ttattctttc agattgtact tggagattcc actgcaaaag caggattacg tcttacgatt  840
ccttccctat ttactccggt aggcagtctc ataacaggat tttccatgag caagtacaac  900
tgtctaagat tattactcta cattggtatt tctttgatgt ttttgggtaa ctttttattc  960
ctgtttattg aaaaaacttc tccgaactgg ttgattggtc tattttttgat acctgcaaat 1020
ctaggacaag gtatcacttt tcctacgacc ttgttttactt tcatatttat gttctctaag 1080
agtgaccaag ctactgcgac atcaactttta tatttattcc gtagtattgg atctgtatgg 1140
ggtgttgcaa tttcagctgg cgtcattcaa ttatctttcg caggtttatt gcgtagtaat 1200
ttgaaaggtc tactggatga aaacaagata aagaaactta tgttcagct tagtgcaaac 1260
tcctcatata ttggatcttt acatggcgaa gttaaaaaca cagtcataaa gagttttgat 1320
gaggcaacaa agagggctca tctaatgtct acattactct cttcattggc cctgatactc 1380
tgcatcctta aagacaatct ggcgaaacct aaaacaagaa gataa            1425

SEQ ID NO: 70
MSISNWITTA YLITSTSFQP LYGSFSDALG RRNCLFFANG AFTIGCLACG FSKNIYMLSF   60
MRALTGIGGG GLITLSTIVN SDVIPSSKRG IFQAFQNLLL GFGAICGASF GGTIASSIGW  120
RWCFLIQVPI SVISSILMNY YVPNQKEYNR QNSSIFQNPG KILRDIDVMG SILIITGLTL  180
QLLYLSLGCS TSKLSWTSPS VLLLLVGSVI ILLLFILHER KTSARAIIPM ELVNSSYSVV  240
VLSISILVGF ASYAYLFTLP LFFQIVLGDS TAKAGLRLTI PSLFTPVGSL ITGFSMSKYN  300
CLRLLLYIGI SLMFLGNFLF LFIEKTSPNW LIGLFLIPAN LGQGITFPTT LFTFIFMFSK  360
SDQTATSTL YLFRSIGSVW GVAISAGVIQ LSFAGLLRSN LKGLLDENKI KKLIVQLSAN  420
SSYIGSLHGE VKNTVIKSFD EATKRAHLMS TLLSSLALIL CILKDNLAKP KTRR        474
```

TABLE 3-continued

Sequences disclosed herein.

SEQ ID NO: 71
```
atgaaggat  tatcctcatt  aataaacaga  aaaaaagaca  ggaacgactc  acacttagat    60
gagatcgaga  atggcgtgaa  cgctaccgaa  ttcaactcga  tagagatgga  ggagcaaggt   120
aagaaaagtg  attttgatct  ttcccatctt  gagtacggtc  caggttcact  aataccaaac   180
gataataatg  aagaagtccc  cgaccttctc  gatgaagcta  tgcaggacgc  caaagaggca   240
gatgaaagtg  agaggggaat  gccactcatg  acagctttga  agacatatcc  aaaagctgct   300
gcttggtcac  tattagtttc  cacaacattg  attcaagagg  gttatgacac  agccattcta   360
ggagctttct  atgccctgcc  tgtttttcaa  aaaaaatatg  gttctttgaa  tagcaataca   420
ggagattatg  aaatttcagt  ttcctggcaa  atcggtctat  gtctatgcta  catggcaggt   480
gagattgtcg  gtttgcaaat  gactgggcct  tctgtagatt  acatgggcaa  ccgttacact   540
ctgatcatgg  cgttgttctt  tttagcggct  ttcattttca  ttctgtattt  ttgcaagagt   600
ttgggtatga  ttgccgtggg  acaggcattg  tgtggtatgc  catggggttg  tttccaatgt   660
ttgaccgttt  cttatgcttc  tgaaatttgt  cctttggccc  taagatacta  tttgacgact   720
tattctaatt  tatgttgggc  gttcggtcaa  cttttcgctg  ctggtattat  gaaaaattcc   780
cagaacaaat  atgccaactc  agaactagga  tataagctac  cttttgcttt  gcagtggatc   840
tggccccttc  ctttggcggt  aggtatttt   tttgcaccag  agtctccatg  gtggctggtt   900
aaaaaaggaa  ggattgatca  agcgaggaga  tcacttgaaa  aacattaag   tggtaaagga   960
cccgagaaag  aattactagt  gagtatgaaa  ctcgataaaa  tcaaaactac  tatagaaaag  1020
gagcagaaaa  tgtctgatga  aggaacttac  tgggattgtg  tgaaagatgg  tattaacagg  1080
agaagaacga  gaatagcttg  tttatgttgg  atcggtcaat  gctcctgtgg  tgcatcatta  1140
attggttatt  caacttactt  ttatgaaaaa  gctggtgtta  gcactgatac  ggcttttact  1200
ttcagtatta  tccaatattg  tcttggtatt  gctgcaacgt  ttatatcctg  gtgggcttca  1260
aaatattgtg  gcagatttga  cctttatgct  tttgggctgg  cttttcaggc  tattatgttc  1320
ttcattatcg  gtgggtttagg atgttcgac  actcatggcg  ctaaaatggg  tagtggtgct  1380
cttctaatgg  ttgtcgcgtt  cttttacaac  ctcggtattg  cacctgttgt  tttttgctta  1440
gtgtctgaaa  taccgtcttc  aaggctaaga  accaaaacaa  ttattttgct  tcgtaatgct  1500
tacaatgtga  tccaagttgt  agttacagtt  ttgatcatgt  accaattgaa  ctcagagaaa  1560
tggaattggg  gtgctaaatc  aggctttttc  tggggaggat  tttgtctggc  cactttagct  1620
tgggctgttg  tcgatttacc  agaaaccgct  ggcaggactt  ttattgagat  aaatgaattg  1680
tttagacttg  gtgttccagc  aagaaagttc  aagtcgacta  aagtcgaccc  ttttgcagct  1740
gccaaagcag  cagctgcaga  aattaatgtt  aaagatccga  ggaagatttt  ggaaacttct  1800
gtggtagatg  aagggcgaaa  cacctcatct  gttgtgaaca  aatga                   1845
```

SEQ ID NO: 72
```
MKGLSSLINR  KKDRNDSHLD  EIENGVNATE  FNSIEMEEQG  KKSDFDLSHL  EYGPGSLIPN    60
DNNEEVPDLL  DEAMQDAKEA  DESERGMPLM  TALKTYPKAA  AWSLLVSTTL  IQEGYDTAIL   120
GAFYALPVFQ  KKYGSLNSNT  GDYEISVSWQ  IGLCLCYMAG  EIVGLQMTGP  SVDYMGNRYT   180
LIMALFFLAA  FIFILYFCKS  LGMIAVGQAL  CGMPWGCFQC  LTVSYASEIC  PLALRYYLTT   240
YSNLCWAFGQ  LFAAGIMKNS  QNKYANSELG  YKLPFALQWI  WPLPLAVGIF  FAPESPWWLV   300
KKGRIDQARR  SLERTLSGKG  PEKELLVSME  LDKIKTTIEK  EQKMSDEGTY  WDCVKDGINR   360
RRTRIACLCW  IGQCSCGASL  IGYSTYFYEK  AGVSTDTAFT  FSIIQYCLGI  AATFISWWAS   420
KYCGRFDLYA  FGLAFQAIMF  FIIGGLGCSD  THGAKMGSGA  LLMVVAFFYN  LGIAPVVFCL   480
VSEIPSSRLR  TKTIILARNA  YNVIQVVVTV  LIMYQLNSEK  WNWGAKSGFF  WGGFCLATLA   540
WAVVDLPETA  GRTFIEINEL  FRLGVPARKF  KSTKVDPFAA  AKAAAAEINV  KDPKEDLETS   600
VVDEGRNTSS  VVNK                                                         614
```

SEQ ID NO: 73
```
atgggaagtc  atcgacgtta  tctctactat  agtatattat  catttctatt  attatcctgc    60
tcagtggtac  ttgcaaaaca  agataagacc  ccattctttg  aaggtacttc  ttcgaaaaat   120
tcgcgtctaa  ctgcacaaga  taagggcaat  gatacatgcc  cgccatgttt  taattgtatg   180
ctacctattt  ttgaatgcaa  acagttttct  gaatgcaatt  cgtacactgg  tagatgtgag   240
tgtatagaag  ggtttgcagg  tgatgattgc  tctctgcccc  tctgtggcgg  tctatcaccg   300
gatgaaagcg  gtaataagga  tcgtcccata  agagcacaaa  atgacacctg  tcattgtgat   360
aacggatggg  gagggatcaa  ttgtgacgtt  tgtcaagaag  attttgtctg  tgatgcgttc   420
atgcctgatc  ctagtattaa  ggggacatgt  tataagaatg  gtatgattgt  agataaagta   480
ttttcaggtt  gtaatgtgac  caatgagaaa  attctacaga  ttttgaacgg  caaaatacca   540
caaattacat  ttgcctgtga  taaacctaat  caagaatgta  attttcagtt  ttggatagat   600
cagttagaaa  gcttctattg  tggcttaagt  gattgtgcct  ttgaatacga  cttggaacag   660
aatacctccc  attataagtg  taatgacgtt  caatgcaaat  gcgttcccga  cactgtgttg   720
tgtggtgcta  aggggtctat  agatatctcg  gatttcctga  cagagacaat  aaaagggcca   780
ggagatttca  gctgtgattt  agaaacaagg  caatgtaaat  tcagtgagcc  ttctatgaat   840
gatttgatat  tgaccgtgtt  tggtgaccct  tatattactt  gaagtgtga   atccggtgaa   900
tgtgttcatt  atagtgagat  tccaggttac  aaatctcctt  caaaagatcc  aacagtgtca   960
tggcaaggga  aattggtgtt  tgcattgact  gctgtgatgg  tcctggcact  ttttacattt  1020
gctacctttt  acatttctaa  atctccgtta  ttcagaaatg  gattgggttc  ctcaaagtct  1080
cccattcgtt  tgccagatga  agatgcgtg   ataattttct  tacaaaatga  agatgacaca  1140
ctggcgacat  taagttttga  aaatatcact  tatagtgtcc  cctcgataaa  ttcagatggt  1200
gttgaagaaa  ctgtgctgaa  tgaaataagt  ggtatcgtga  agcccggcca  aatattagct  1260
atcatgggtg  gatctggtgc  gggtaaaact  acttttattag atatcctagc  aatgaaacgg  1320
aaaacaggtc  acgtttcggg  ttccataaaa  gttaacggta  ttagtatgga  ccgtaaatct  1380
ttctcgaaaa  taatcgggtt  cgtcgatcaa  gatgactttt  gctgcccac   tttgactgtt  1440
tgaaaccgt   tattaaatag  tgcgctgtta  agattgccaa  aagcattgtc  attcaggcc   1500
aagaaggcaa  gagtttataa  ggtgttgaa   gaactaagaa  ttattgatat  caaagatcgt  1560
attattggta  atgaatttga  tcgtggtatt  agtggaggtg  aaaaacgccg  agtttccatt  1620
gcatgtgaat  tagtgacatc  tccattggtt  ttattttgg   atgaacctac  atctggttta  1680
gatgctagta  atgccaataa  tgttattgaa  tgtttggtaa  ggttatccag  cgactataac  1740
aggacattgg  tgctatctat  tcatcagcca  agatcaaata  tattttattt  attcgataaa  1800
```

TABLE 3-continued

Sequences disclosed herein.

```
ttggtcctgt taagtaaagg tgagatggtc tattccggaa atgccaaaaa agtgtcagaa  1860
tttttgagaa atgagggata tatctgtccg gacaactata atattgctga ttatttgatt  1920
gatattactt ttgaagccgg tcctcagggg aaaaggagaa gaatcagaaa catttccgat  1980
ttagaagctg gtacggatac taacgatatt gataatacga tacaccaaac aacatttact  2040
agcagtgatg gtacaacaca gagagagtgg gctcatcttg cagctcatag agatgagatc  2100
agatctttac tcagagatga agaagatgta gagggaacag atggaaggcg aggtgctact  2160
gagattgact taaataccaa actactacac gataaatata aagatagcgt ctattatgca  2220
gagcttcac aggagatcga ggaagttta agcgaaggtg atgaggaaag taacgttttg  2280
aatggagatt tacccacagg tcaacaatct gctggttttc tgcaacagtt atcgatattg  2340
aattcaagaa gttttaaaaa catgtacaga aaccctaaac tattattggg taattattta  2400
ctgacgatcc tattgagttt attcttggga acactatatt acaacgtctc caatgatatc  2460
agcggttttc agaacagaat ggggctgttc ttctttatac taacgtactt cggttttgtt  2520
acattcacag gtctcagctc gttcgctctg gaaaggatca ttttcataaa agaaagatcc  2580
aataactatt actcgccact tgcatactac attagtaaga taatgagcga agtggtcccg  2640
ctacgtgttg taccacctat actcttgtca ttgattgttt acccaatgac tggttaaac  2700
atgaaagaca atgctttttt taaatgtatt ggaatcctta tactgtttaa ccttgggata  2760
tcgttggaaa tcctaaccat cggcataatt tttgaagact tgaataactc cataatatta  2820
agcgtgctgg tgcttttggg ctcactactg tttagcggac tatttatcaa tactaagaat  2880
attacaaacg tggccttcaa gtacctgaaa aacttctctg tgttttacta cgcctacgaa  2940
tctttattga tcaatgaggt caaaacattg atgctgaaag agagaaagta cggcttaaat  3000
attgaagttc caggcgctac tatcttgagc acatttggat tgttgtcca aaaccttgta  3060
tttgacatca agatcctggc tctgttaat gtggtgtttt taataatggg gtatctagcc  3120
cttaagtgga tagttgtgga acaaaagtag                                   3150

SEQ ID NO: 74
MGSHRRYLYY SILSFLLLSC SVVLAKQDKT PFFEGTSSKN SRLTAQDKGN DTCPPCFNCM    60
LPIFECKQFS ECNSYTGRCE CIEGFAGDDC SLPLCGGLSP DESGNKDRPI RAQNDTCHCD   120
NGWGGINCDV CQEDFVCDAF MPDPSIKGTC YKNGMIVDKV FSGCNVTNEK ILQILNGKIP   180
QITFACDKPN QECNFQFWID QLESFYCGLS DCAFEYDLEQ NTSHYKCNDV QCKCVPDTVL   240
CGAKGSIDIS DFLTETIKGP GDFSCDLETR QCKFSEPSMN DLILTVFGDP YITLKCESGE   300
CVHYSEIPGY KSPSKDPTVS WQGKLVLALT AVMVLALFTF ATFYISKSPL FRNGLGSSKS   360
PIRLPDEDAV NNFLQNEDDT LATLSFENIT YSVPSINSDG VEETVLNEIS GIVKPGQILA   420
IMGGSGAGKT TLLDILAMKR KTGHVSGSIK VNGISMDRKS FSKIIGFVDQ DDFLLPTLTV   480
FETVLNSALL RLPKALSFEA KKARVYKVLE ELRIIDIKDR IIGNEFDRGI SGGEKRRVSI   540
ACELVTSPLV LFLDEPTSGL DASNANNVIE CLVRLSSDYN RTLVLSIHQP RSNIFYLFDK   600
LVLLSKGEMV YSGNAKKVSE FLRNEGYICP DNYNIADYLI DITFEAGPQG KRRRIRNISD   660
LEAGTDTNDI DNTIHQTTFT SSDGTTQREW AHLAAHRDEI RSLLRDEEDV EGTDGRRGAT   720
EIDLNTKLLH DKYKDSVYYA ELSQEIEEVL SEGDEESNVL NGDLPTGQQS AGFLQQLSIL   780
NSRSFKNMYR NPKLLLGNYL LTILLSLFLG TLYYNVSNDI SGFQNRMGLF FFILTYFGFV   840
TFTGLSSFAL ERIIFIKERS NNYYSPLAYY ISKIMSEVVP LRVVPPILLS LIVYPMTGLN   900
MKDNAFFKCI GILILFNLGI SLEILTIGII FEDLNNSIIL SVLVLLGSLL FSGLFINTKN   960
ITNVAFKYLK NFSVFYYAYE SLLINEVKTL MLKERKYGLN IEVPGATILS TFGFVVQNLV  1020
FDIKILALFN VVFLIMGYLA LKWIVVEQK                                    1049

SEQ ID NO: 75
atggcgcgtc aaaagcttac tttcaaagaa caaatggatg gtttcccctg ggtccaactt    60
gttgttgtgt ccttagttag gttcagcgaa ccaattgcgt tttcgtcact atttccttat   120
gtttatttca tggttagaga ttttaatatt gctcccaatg atgctcaagt gtccaaatat   180
tcaggttatt tatcttcatc atttgcgtta tgccaagtca tatctgcgta ccactggggt   240
agattctctg aaaagctgg cagaaaaata acattgactt gcgggcttat aggaacatct   300
gtatcattgt taatactggg atttccacgc aatttctatc aggctttggt ggcaagaagt   360
taatgggat tgctaaatgg taacgtcggc gttattagaa ccattattgg tgaaatagca   420
actgaaagaa aacatcaggc tttagctttc agtactatgc ctttattatt tcaatttggt   480
gccgttgttg ggcctatgat cggtgggttt cttgtattta gagatggaac aatgaatgaa   540
gtgccactat ggtttccaca ttttgcaaaa agaataatta ggtcatatcc gtacgccttg   600
ccaaacgtgg tagtgtgcat gtttttgatg tttggtttaa ctaatgcaac attgttttg   660
gaagaaacac atcctgcttt taagatagaa agagattacg gttagaggt cggtgatttt   720
attaagaaga atatatttgg tatacagccg aaaagaagac cctggcaaaa gcgcattcag   780
gatgattcgg aaaacattca ccaccgtaat gagaatgtga acagcattcg aggacaagat   840
agtgaagagg atgaaaatag tcccctagtg aatactacca atgacgatga tactgaaagc   900
atacaatcga ttgatcctat tttaacaaga agacagtctg taggcctgat taggacatat   960
tctctgcatg aaccaacaga cgctgtgcat gccaatatag atacagctcc agacggttgt  1020
aaagaaagta gtatatttca tcacgttttt catacaaaag tattttaccc tatatcggtg  1080
aattttatta tggctttaca tttgattgta tacaacgaat tttgcctgt ttttttagct  1140
tatgatttag ccgtagatcc agaaaatcca aagaagctgg cttcaaaatt tccgtggaaa  1200
atatctggcg gtataggtta tgaaccagaa caaaccggta ctctttttgtc gacaacaggt  1260
atctttggtt gttttgtggt tattttcatt tttcccatag ttgatcgaaa tttcgattgt  1320
ttaacaattt tcagaacttt agtcaagctg taccctatta tgtacgttat ggttccttac  1380
gttgtttttc tacagaatga acggattcct agctggtata ctgtcgtcta cttgtacata  1440
atcacaggga taaaacatt tgtggcgct taacgtcac cacaaattat gttattaatt  1500
cataattgtc gtccttgag ttgtagatca gtcatcaatg gcgccaccat tagtatttct  1560
gcctctgctc gtttcatagg tcccttagta tggggctata ttatgtcttg gtcccagcaa  1620
aatgacgtcg cctgggtcag ttggtggtcg ttaagtcttt tttgtatggt agctctttat  1680
caaagttata agatagcacc aattgatgat aacgaaaatg agcttcatgg acagggtagt  1740
gaagatgcct acaattcgca gtcacagtct tctgatttaa gaatggctca tcgatctagt  1800
ttaagcagct taagtaacca acgctgtacc acatga                            1836
```

TABLE 3-continued

Sequences disclosed herein.

```
SEQ ID NO: 76
MARQKLTFKE QMDGFPWVQL VVVSLVRFSE PIAFSSLFPY VYFMVRDFNI APNDAQVSKY     60
SGYLSSSFAL CQVISAYHWG RFSEKHGRKI TLTCGLIGTS VSLLILGFSR NFYQALVARS    120
LMGLLNGNVG VIRTIIGEIA TERKHQALAF STMPLLFQFG AVVGPMIGGF LVFRDGTMNE    180
VPLWFPHFAK RIIRSYPYAL PNVVVCMFLM FGLTNATLFL EETHPAFKDR RDYGLEVGDF    240
IKKNIFGIQP KRRPWQKRIQ DDSENIHHRN ENVNSIRGQD SEEDENSPLV NTTNDDDTES    300
IQSIDPILTR RQSVGLIRTY SLHEPTDAVH ANIDTAPDGC KESSIFHHVF HTKVFYPISV    360
NFIMALHLIV YNEFLPVFLA YDLAVDPENP KKLASKFPWK ISGGIGYEPE QTGTLLSTTG    420
IFGCFVVIFI FPIVDRNFDC LTIFRTLVKL YPIMYVMVPY VVFLQNERIP SWYTVVYLYI    480
ITGIKTFCGA LTSPQIMLLI HNSSPLSCRS VINGATISIS ASARFIGPLV WGYIMSWSQQ    540
NDVAWVSWWS LSLFCMVALY QSYKIAPIDD NENELHGQGS EDAYNSQSQS SDLRMAHRSS    600
LSSLSNQRCT T                                                         611

SEQ ID NO: 77
atggatttaa ccgtggaacc taatttgcac tctttaatta cctctaccac tcataagtgg     60
attttcgttg gtggtaaagg tggtgttggt aagactactt catcatgttc cattgctatc    120
caaatggctt tgagtcaacc aaacaaacag ttcctactga tctctactga tcctgcccat    180
aacttaagtg atgcattcgg tgagaaattt ggtaaagacg ccagaaaggt gacaggcatg    240
aataatctat catgtatgga aatcgatcca tccgctgctt tgaaggatat gaacgacatg    300
gcagtttcac gcgctaacaa taacggaagt gacggtcaag gtgacgatct aggaagcttg    360
cttcaaggtg gtgctcttgc tgatttgacc ggttccatcc ctggtatcga cgaagcttta    420
tccttcatgg aagtcatgaa gcacattaaa aggcaagaac agggcgaagg tgaaacctte    480
gatactgtta ttttgacac tgctccaact ggccacacat taagattct acaactacca    540
aatactttat ccaagctttt ggaaaagttc ggtgaaatta ccaacaaatt gggcccaatg    600
ctaaactctt tatgggcgc aggtaatgtc gatatctctg gaaaattgaa cgagttaaag    660
gctaatgtcg agaccatcag acaacaattc acggatcctg acctaactgc ttttgtttgc    720
gtttgtatca gtgaattctt atccttatat gaaactgaaa gactaattca ggaattgatt    780
tcctacgata tggacgttaa ttccatcatt gtcaaccaat tatatattgc tgaaaacgat    840
caagagcaca actgtaagag atgtcaggca agatggaaga tgcaaaagaa gtacttggac    900
caaatcgacg aattgtacga agatttccat gtcgttaaaa tgccattatg tgctggagaa    960
atcagaggct taaataactt aacaaagttc tcacagttcc taaacaaaga atataaccct   1020
attactgatg gcaaagtcat ttatgagtta aagataagg aatag                    1065

SEQ ID NO: 78
MDLTVEPNLH SLITSTTHKW IFVGGKGGVG KTTSSCSIAI QMALSQPNKQ FLLISTDPAH     60
NLSDAFGEKF GKDARKVTGM NNLSCMEIDP SAALKDMNDM AVSRANNNGS DGQGDDLGSL    120
LQGGALADLT GSIPGIDEAL SFMEVMKHIK RQEQGEGETF DTVIFDTAPT GHTLRFLQLP    180
NTLSKLLEKF GEITNKLGPM LNSFMGAGNV DISGKLNELK ANVETIRQQF TDPDLTTFVC    240
VCISEFLSLY ETERLIQELI SYDMDVNSII VNQLLFAEND QEHNCKRCQA RWKMQKKYLD    300
QIDELYEDFH VVKMPLCAGE IRGLNNLTKF SQFLNKEYNP ITDGKVIYEL EDKE           354

SEQ ID NO: 79
atgactgagc aagcaactaa gccaagaaat tcatcgcatt tgatcgggg cttttcgt      60
gggctaacat ctgctgttgc gttgcaacct ttagacctt tgaagacgag aatccagcaa    120
gacaagaaag ctacattatg gaaaaatttg aaagagatag acagccctct acagctatgg    180
agaggtacat taccttcagc attacgaaca tcaataggca gcgccttata tttatcatgt    240
ttgaacctta tgcgctcatc tttggcaaag aggaggaatg ctgtgccttc attaacaaac    300
gattcaaaca ttgtatataa caagagcagt agcttaccac gattaacgat gtatgaaaat    360
ttactaacag gtgcatttgc aagaggtttg gtaggttata taaccatgcc tatcaccgtc    420
attaaagtcc gttatgagtc tactctgtac aattactcca gttaaaagga ggcaattacc    480
catatatata ctaaggaagg actttttgga ttttcagag ggtttggagc tacttgtta    540
agagacgctc cctatgcagg tttgtatgtg ctgctatatg aaaatcgaa acaattactg    600
cccatggtat taccttctag gtttatacat tacaatcctg agggaggatt tactacttat    660
acctctacaa cagtaaatac aacaagcgcc gtactatccg ccagtttagc caccacagta    720
acggcaccgt tcgacaccat aaaaacgaga atgcaattgg aaccatcaaa atttaccaac    780
tccttcaata catttacatc tatagttaaa aatgaaaatg tgctgaagtt atttagcggg    840
ttaagcatga ggctggcaag aaaggccttc agtgcaggta ttgcgtgggg tatatatgag    900
gagttggtca aaagattcat gtaa                                           924

SEQ ID NO: 80
MTEQATKPRN SSHLIGGFFG GLTSAVALQP LDLLKTRIQQ DKKATLWKNL KEIDSPLQLW     60
RGTLPSALRT SIGSALYLSC LNLMRSSLAK RRNAVPSLTN DSNIVYNKSS SLPRLTMYEN    120
LLTGAFARGL VGYITMPITV IKVRYESTLY NYSSLKEAIT HIYTKEGLFG FFRGFGATCL    180
RDAPYAGLYV LLYEKSKQLL PMVLPSRFIH YNPEGGFTTY TSTTVNTTSA VLSASLATTV    240
TAPFDTIKTR MQLEPSKFTN SFNTFPTSIVK NENVLKLFSG LSMRLARKAF SAGIAWGIYE    300
ELVKRFM                                                               307

SEQ ID NO: 81
atgaacgata gccaaaactg cctacgcacag agggaagaaa atagtcatct gaatcctgga    60
aatgacttcg gccaccacca gggtgcagaa tgtacgataa tcataacaa catgccacac    120
cgcaatgcat acacagaatc tacgaatgac acggaagcaa agtccatagt gatgtgcgac    180
gatcctaacg cataccaaat ttcctacaca aataatgaca cggcgggaa tggagctata    240
gaaccacgt ccattctact atcgcaaccg ctgccgctgc gatcgatgt gatgtctgtc    300
ttggtaggca tatttgttgc cgtggggggc ttcttgtttg gtatgacac tggacttata    360
aacagtatca cggatatgcc gtatgttaaa acctacattg ctccgaacca ttcatatttc    420
accactagcc aaatagccat actcgtatca ttcctctccc taggaacatt tttccggtgcg    480
ttaatcgctc cctatatttc agattcatat ggtaggaagc aacaattat gtttagtacc    540
```

TABLE 3-continued

Sequences disclosed herein.

```
gctgttatct tttccatcgg aaactcatta caggtggcat ccggtggctt ggtgctatta    600
atcgtcggaa gagtgatctc aggtatcggg atcgggataa tctctgctgt ggttcctctt    660
tatcaagctg aagctgcgca gaagaacctt agaggtgcca tcatttccag ttatcagtgg    720
gctatcacta ttgggttact cgtgtccagt gcagtatcgc aaggaactca ttccaaaaat    780
ggcccgtctt catatagaat accaattggt ttgcagtacg tttggtcaag tattttagct    840
gtgggcatga tattccttcc agagagtcca agatattacg tcttgaagga tgaactcaat    900
aaagctgcaa aatcgttatc cttttaaga ggcctcccga tcgaagatcc aagactctta    960
gaggagcttg ttgaaataaa agccacttac gattatgaag catcgttcgg cccgtcaaca   1020
cttttagatt gtttcaaaac aagtgaaaat agacccaaac agattttacg aatatttact   1080
ggtatcgcca tacaagcttt tcaacaggca tctggtatca attttatatt ctactatgga   1140
gttaatttt tcaacaacac aggggtggac aactcttact tggtttcttt tatcagctat    1200
gccgtcaacg tcgccttcag tataccgggt atgtatttga tggatcgaat tggtagaaga   1260
ccagtccttc ttgctggagg tgtcataatg gcaatagcaa atttagtcat tgccatcgtt   1320
ggtgtttccg agggaaaaac tgttgttgct agtaaaatta tgattgcttt tatatgcctt   1380
ttcattgctg cattttcggc gacatggggt ggtgtcgtgt gggtggtatc tgctgaactg   1440
tacccacttg gtgtcagatc gaaatgtacc gccatgcgg ctgccgcaaa ttggctagtt   1500
aatttcacct gtgccctgat tacaccttac attgttgatg tcgatcaca cacttcttca   1560
atggggccca aatattctt catttgggc ggcttaaatg tcgtgccgt tatcgttgtt    1620
tatttcgctg tttatgaaac gaggggattg actttggaag agattgacga gttatttaga   1680
aaggccccaa atagcgtcat ttctagcaaa tggaacaaaa aaataaggaa aaggtgctta   1740
gcctttccca tttcacaaca aatagagatg aaaactaata tcaagaacgc tggaaagttg   1800
gacaacaaca acagtccaat tgtacaggat gacagccaca acataatcga tgtggatgga   1860
ttcttggaga accaaataca gtccaatgat catatgttg cggcggataa aggaagtggc   1920
tcgttagtaa acatcatcga tactgccccc ctaacatcta cagagtttaa acccgtgaa    1980
catccgccag taaattacgt cgacttgggg aatggtttgg gtctgaatac atacaataga   2040
ggtcctcctt ctatcatttc tgactctact gatgagttct atgaggaaaa tgactcttct   2100
tattacaata acaacactga acgaaatgga gctaacagcg tcaatacaca tatggctcaa   2160
ctaatcaata gctcatctac tacaagcaac gacacatcgt tctctccatc acacaatagc   2220
aatgcaagaa cgtcctctaa ttggacgagt gacctcgcta gtaagcacag ccaatacact   2280
tccccccaat aa                                                        2292

SEQ ID NO: 82
MNDSQNCLRQ REENSHLNPG NDFGHHQGAE CTINHNNMPH RNAYTESTND TEAKSIVMCD     60
DPNAYQIST NNEPAGDGAI ETTSILLSQP LPLRSNVMSV LVGIFVAVGG FLFGYDTGLI    120
NSITDMPYVK TYIAPNHSYF TTSQIAILVS FLSLGTFFGA LIAPYISDSY GRKPTIMFST   180
AVIFSIGNSL QVASGGLVLL IVGRVISGIG IGIISAVVPL YQAEAAQKNL RGAIISSYQW   240
AITIGLLVSS AVSQGTHSKN GPSSYRIPIG LQYVWSSILA VGMIFLPESP RYYVLKDELN   300
KAAKSLSFLR GLPIEDPRLL EELVEIKATY DYEASFGPST LLDCFKTSEN RPKQILRIFT   360
GIAIQAFQQA SGINFIFYYG VNFFNNTGVD NSYLVSFISY AVNVAFSIPG MYLVDRIGRR   420
PVLLAGGVIM AIANLVIAIV GVSEGKTVVA SKIMIAFICL FIAAFSATWG GVVWVVSAEL   480
YPLGVRSKCT AICAAANWLV NFTCALITPY IVDVGSHTSS MGPKIFFIWG GLNVVAVIVV   540
YFAVYETRGL TLEEIDELFR KAPNSVISSK WNKKIRKRCL APFPISQQIEM KTNIKNAGKL   600
DNNNSPIVQD DSHNIIDVDG FLENQIQSND HMIAADKGSG SLVNIIDTAP LTSTEFKPVE   660
HPPVNYVDLG NGLGLNTYNR GPPSIISDST DEFYEENDSS YYNNNTERNG ANSVNTYMAQ   720
LINSSSTTSN DTSFSPSHNS NARTSSNWTS DLASKHSQYT SPQ                      763

SEQ ID NO: 83
atgaaacctc cgttaaacat gtcacgttca aataaaccac ttactcagga agctaatagt     60
tcggcgcata ttgatagggc acatcagcta gcacaggatt ttaacagtaa acaggatgat   120
accgcactaa cttcactgcc ccacaagaac cccgacatat tcagatttga gaacaacatc   180
acagctcata gctcgcgtcg tggttctcta tatagagaca gcgatgctac tgtggttttg   240
ccgcttttctg aacataccc tagattatca atggatgatc cataccgcca attactacaa   300
caggctgaaa tctcacaact acgaagtaag aaaaaaaggc attccagtcg agttttgcgt   360
acttcgttta tatctttttgt ggtgctagtt tcctcgctgt cagggttgga ccaaggcctc   420
atatctggta acgttatgac tttgtcgttc cagaagtatt ttcattaccc acttacttct   480
ccgctgggca atatagtgag cattgttaat ctgggtgcgt tcatgcgtc gttatttgtc     540
tattctggca tcctggagcc ttgtagcagg aaaaaatgc tccaaataag cacaatgata   600
tactctttgg gtgccattgt tcaggtcttg gctctaaacc aatggtgttt actactgggt   660
agattcttac tcggagtagg tatgggcttt gccttttcta tggtaataat ttatcaattc   720
gagtttcccc ttccctgtat aagaaaacgg acattaattt ccattcaatg cgtctctagt   780
gtcattgcgt attcattcgg aatatggatt aattgtgctt tcagatattt gggctttgca   840
tggagatacc ctttgtcaac acatgtggca cttggaataa tactaaaacct aatgtcgttc    900
tatcttattt tagagtcccc ttcgtggctg ttgaagcaaa agaacgacgt agaggcattg   960
gttttaatat cgaatgtttt cgatgatgga aatttcgaag aaaaccaaac tcagttgaaa  1020
tttagggtcc tgaaacgaga catattatta aagtcacacc ttcaaaaaaa ctcctatcca  1080
tatgcgtata tcttaaagga tttttcttca ataataaaat tgttgatagg tttccaactt  1140
ctcacacgaa caaatggagt ggatgctttc ttgtattact caccgttaat attacaacaa  1200
atggggagag agaaagaaaa atctatctat ttaacgggc ttaatgcttt aatttacagc   1260
atcgtaatat tagcatatgt tcccttggtg ttacggaaac gtaaagagaa acgaatgta   1320
ctcttaggtt cgattgtgat gtgtgcattg ctatttacca tatctttac agactggttt   1380
cccaagagca caacgaggta tatatcaata ctatttgctg ttttttcttt tacgcacttc  1440
atcagttggg attctataggg atgggttatg accattgagc ttctacctca cttgtcacag  1500
gccccagtga tactactagt ctcaaactttt tattggtttt tatggttt cgtcagctta    1560
ataaccccta tacttattga ccgtctgtct tggaagtttt atcttattcc atctttatct  1620
tcctttattt ccattatatt tgtgctgaag atttttccta tagaacccg tgacgaaagg   1680
ttagattctg atgatgattc taccggaaac ggtagcggta accatgatga tgtttttgac  1740
gataccggtt ctgaattctc ctcctcacca tcttttttccg cgtatcagat aaacactcta  1800
ggaagtagta tcaaacaaaa taatcaagcc tattcatcta ttcaaaatga gcagattcta  1860
```

TABLE 3-continued

Sequences disclosed herein.

```
cccaaaaacg gaaacttatc gaaccagaca cacggttctg cacaaaatgt ttatttcatt   1920
acatctgatt caggaccatc aaggactgga gaattttca gttttcataa cagaaccgat   1980
ccaaatatca gcgacaacat tgctgcgaat aaacccagtt caggtggagg ccagaattcg   2040
cctggagaca tggcagttgc ctag                                           2064

SEQ ID NO: 84
MKPPLNMSRS NKPLTQEANS SAHIDRAHQL AQDFNSKQDD TALTSLPHKN PDIFRFENNI     60
TAHSSRRGSL YRDSDATVVL PLSEHTPRLS MDDPYRQLLQ QAEISQLRSK KKRHSSRVLR    120
TSFISFVVLV SSLSGLDQGL ISGNVMTLSF QKYFHYPLTS PLGNIVSIVN LGAFMASLFV    180
YSGILEPCSR KKMLQISTMI YSLGAIVQVL ALNQWCLLLG RFLLGVGMGF AFSMVIIYQF    240
EFPLPCIRKR TLISIQCVSS VIAYSFGIWI NCAFRYLGFA WRYPLSTHVA LGIILNLMSF    300
YLILESPSWL LKQKNDVEAL VLISNVFDDG NFEENQTQLK FRVLKRDILL KSHLQKNSYP    360
YAYILKDFSS IIKLLIGFQL LTRTNGVDAF LYYSPLILQQ MGRGERKSIY LTGLNALIYS    420
IVILAYVPLV LRKRKEKTNV LLGSIVMCAL LFTISFTDWF PKSTTRYISI LFAVFLFTHF    480
ISWDSIGWVM TIELLPHLSQ APVILLVSNF YWIFKWFVSL ITPILIDRLS WKFYLIPSLS    540
SFISIIFVLK IFPIETRDER LDSDDDSTGN GSGNHDDVFD DTGSEFSSSP SFSAYQINTL    600
GSSIKQNNQA YSSIQNEQIL PKNGNLSNQT HGSAQNVYFI TSDSGPSRTG EFFSFHNRTD    660
PNISDNIAAN KPSSGGGQNS PGDMAVA                                        687

SEQ ID NO: 85
atgagtatgt caagcaaaaa cgagaataag atatcagtag aacaaagaat atccactgat    60
atcggtcagg cttaccagtt acaaggcctt gggtctaacc taaggtcgat tcgctccaag   120
actggtgccg gtgaagtgaa ctatatcgat gctgctaaat ctgtaaatga taaccaactg   180
cttgcagaga tcggttataa acaagaatta aaaagacaat tttcaacatt acaagttttc   240
ggtattgcgt tctccattat gggtctattg ccctccattg catctgtgat gggtggtggg   300
ctcggtggtg gtccagcaac attagtgtgg ggttggttcg ttgctgcgtt tttcatttta   360
ctggtgggta ttaccattgg tgaacatgca agttccattc ctaccgctgg tggtttgtac   420
tactggacgt attactatgc tccagaaggt tataaagaga ttatttcttt tattattggt   480
tgctcaaact ccctagcgtt ggcagccggt gtgtgttcca ttgattacgg tttggctgag   540
gaaattgctg ctgctgtcac attaaccaaa gatggaaatt ttgaagtaac gagtgggaaa   600
ctttacggta tatttgctgg agcagtggtg gttatgtgta tttgtacatg tgttgcttct   660
ggggccattg ctcgtctgca gacgctaagt atatttgcaa atcttttcat tattgtttta   720
ttgttcattg cgctaccgat tggtaccaag catagaatgg gaggtttcaa tgatggtgac   780
tttatatttg ggaaatatga aaacttaagt gactggaata atggttggca attttgtctt   840
gctggtttca tgcctgctgt ctggactatt ggttcctttg attcatgtgt ccatcaatct   900
gaagaagcca aagatgccaa gaaatcagtc cccattggta taatctcatc tattgctgtt   960
tgttggattt taggttggtt gattattatt tgtttaatgg cctgtatcaa ccctgatatt  1020
gacagcgttt tggactccaa gtacggcttt gctttggctc aaataattta tgattcgtta  1080
ggaaaaaaat gggccattgc atttatgtca ttgatcgcat tctgtcaatt tctaatgggt  1140
gcttccatta ccacagctgt ttctagacaa gtttggcgat tttcccgtga taacggtttg  1200
cccctatcaa agtatattaa aagagtggat tctaaatact cggtcccttt tttcgctatt  1260
ttggctgcct gtgtaggttc cttgatttta ggattgttat gtttgattga tgatgccgcc  1320
actgatgcat tatttagtct ggctgttgca ggaaacaatt tggcatggag tacccctaca  1380
gttttccgtt taacatcagg tagagattta tttagacctg gtccatttta tttgggtaaa  1440
atctggtctc caattgttgc ttggacaggt gttgctttcc aattgttcat tattattttg  1500
gttatgttcc cctctcaaca acatggtatt actaaatcca caatgaatta tgcatgcgtt  1560
attggtcccg gtatctggat ccttgcaggt atctactaca aagtttacaa gaagaaatac  1620
taccacggtc cagcaaccaa tttgtcggat gatgattata ctgaagccgt tggtgctgat  1680
gttatcgaca caattatgtc caaacaggaa ccataa                             1716

SEQ ID NO: 86
MSMSSKNENK ISVEQRISTD IGQAYQLQGL GSNLRSIRSK TGAGEVNYID AAKSVNDNQL     60
LAEIGYKQEL KRQFSTLQVF GIAFSIMGLL PSIASVMGGG LGGGPATLVW GWFVAAFFIL   120
LVGITMAEHA SSIPTAGGLY YWTYYYAPEG YKEIISFIIG CSNSLALAAG VCSIDYGLAE   180
EIAAAVTLTK DGNFEVTSGK LYGIFAGAVV VMCICTCVAS GAIARLQTLS IFANLFIIVL   240
LFIALPIGTK HRMGGFNDGD FIFGKYENLS DWNNGWQFCL AGFMPAVWTI GSFDSCVHQS   300
EEAKDAKKSV PIGIISSIAV CWILGWLIII CLMACINPDI DSVLDSKYGF ALAQIIYDSL   360
GKKWAIAFMS LIAFCQFLMG ASITTAVSRQ VWAFSRDNGL PLSKYIKRVD SKYSVPFFAI   420
LAACVGSLIL GLLCLIDDAA TDALFSLAVA GNNLAWSTPT VFRLTSGRDL FRPGPFYLGK   480
IWSPIVAWTG VAFQLFIIIL VMFPSQQHGI TKSTMNYACV IGPGIWILAG IYYKVYKKKY   540
YHGPATNLSD DDYTEAVGAD VIDTIMSKQE P                                   571

SEQ ID NO: 87
atggcaagcg aacagtcctc accagaaatt aatgcagata atctaaacag tagtgcagct    60
gacgttcatg tacagccacc cggagagaaa gaatggtcag acgggtttta tgacaaagaa   120
gtcattaatg gaaatacgcc agacgcaccg aagagaggct ttttaggtta ccttattatc   180
tacttactat gctatcctgt atcctttggc ggttttttac ctggttggga tagtggtatt   240
actgcaggct tcatcaatat ggataacttt aaaatgaatt ttggttctta caagcacagt   300
actggtgagt attatttgag caacgtgcgt atgggtcttc tcgtggccat gttcagtgta   360
ggatgttcca ttggcggtgt tgcttttgcg agacttgctg atacttttagg tagaaggcta   420
gcaattgtaa tcgtggtttt ggtatatatg gttggtgcaa ttattcagat cagttcgaat   480
cacaaatggt accaatactt tgtcggtaag atcatctacg tcttggtgc tggtggctgt   540
tcggttgttg gtcaatgct tttatctgaa atagcccca cagatttgag aggtggactt   600
gtctcattgt accaacttaa catgaccttc ggtatttct gggttattg tagcgtttat   660
ggaacaagga agtatagtaa tactgcgcaa tggaggattc ctgtgggact atgctttctg   720
tgggctctaa ttatcatcgt tggcatgtta ttagttccag agtccccaag atatctgatt   780
gaatgtgaga gacatgaaga ggcctgtgtc tccatcgcca agatcaacaa ggtttcacca   840
gaggatccat gggtactcaa acaggctgat gaaatcaacg ccggtgtcct tgcccaagag   900
```

TABLE 3-continued

Sequences disclosed herein.

```
gaactagggg aagcctcatg gaaagaactt ttctccgtca aaacaaaagt ccttcaacgt    960
ttgatcacag gtattcttgt gcaaaccttt ttgcaactta ctggtgaaaa ctacttcttc   1020
ttctacggaa ctaccatttt caaatcagtt gggcttactg atggtgtttga gacttcgatc   1080
gtcctaggta cagtgaattt cttctccact attattgctg ttatggtcgt agacaaaata   1140
ggccgtcgta aatgtctgtt attcggagcg gcttcaatga tggcttgtat ggtcatattt   1200
gcaagtatcg gggtaaaatg tctttaccct catggccagg atggtccatc ctcgaaaggt   1260
gcaggtaatg ccatgatgt gttcacatgc ttctatatat tctgctttgc aacgacatgg   1320
gcccctgttg cttatattgt ggttgccgag tcattccctt cgaaggtcaa atctaaagca   1380
atgtcaattt cgactgcatt caactggtta tggcaattct tgattggttt tttcacacca   1440
ttcattactg ggtctatcca cttctattat ggttatgtgt tcgtaggttg tttggttgct   1500
atgtttttgt acgttttctt cttttcacca gaaacaattg gtctatctt ggaggaaata   1560
cagttactat atgaagaagg tataaaacca tggaaatctg catcttgggt accaccctca   1620
aggagaggag cttcttccag ggaaactgag gctaagaaga aaagctggaa agaagttttg   1680
aagttcccaa agagttttaa ttga                                          1704

SEQ ID NO: 88
MASEQSSPEI NADNLNSSAA DVHVQPPGEK EWSDGFYDKE VINGNTPDAP KRGFLGYLII     60
YLLCYPVSFG GFLPGWDSGI TAGFINMDNF KMNFGSYKHS TGEYYLSNVR MGLLVAMFSV    120
GCSIGGVAFA RLADTLGRRL AIVIVVLVYM VGAIIQISSN HKWYQYFVGK IIYGLGAGGC    180
SVLCPMLLSE IAPTDLRGGL VSLYQLNMTF GIFLGYCSVY GTRKYSNTAQ WRIPVGLCFL    240
WALIIIVGML LVPESPRYLI ECERHEEACV SIAKINKVSP EDPWVLKQAD EINAGVLAQR    300
ELGEASWKEL FSVKTKVLQR LITGILVQTF LQLTGENYFF FYGTTIFKSV GLTDGFETSI    360
VLGTVNFFST IIAVMVVDKI GRRKCLLFGA ASMMACMVIF ASIGVKCLYP HGQDGPSSKG    420
AGNAMIVFTC FYIFCFATTW APVAYIVVAE SFPSKVKSKA MSISTAFNWL WQFLIGFFTP    480
FITGSIHFYY GYVFVGCLVA MFLYVFFFLP ETIGLSLEEI QLLYEEGIKP WKSASWVPPS    540
RRGASSRETE AKKKSWKEVL KFPKSFN                                        567

SEQ ID NO: 89
atgagtacca ataagttcgt tgtacgaata acgaatgcgc tcttcaagtc atcactggct     60
agcaacagtc cacctgttta ccctaagagg attaggcatt tcgagatttt acccaacgaa    120
aaatgggtta tatgggggacc tggaaagggc aagttcttgg atgtactgaa taacaagtat    180
atttgtgagc ccccattatc tttgaggttt ggattttga aggaaagttc gaacatccta    240
ccgaggatag agcaagtggc cttcaaaggg gttatgccaa cggctcattt aagtgctaga    300
tatgaatact tcaaagatga ctacgatcaa acctgcaaac agtttatatt tgataaggca    360
agcggatcaa atgctgtttc atataaagtt gagacgaaca atcggcaaat aaacatggag    420
ctgtcaaatg cattagttga aaatttaaac ctctccagtt tacaggatag gtgggtaatg    480
ggattgagta atggacaaat gaggagagca aggttagctc gtagtatact caaggaaccg    540
gatctactac ttattgacga cccattttta gggttggatc cagccgcaat agcaaccatt    600
tcacaatttt tagccaaata tgatagtata gaagtcagtg gcggatgtcc aatcgtcatt    660
ggtttggggt atcaagtac cattccagca tggtgtatct atatatgttg cgttgatgag    720
aaaaacggta tattgtttga aggcccaatc gaaaaacttc aaagtaaaat ggatgaaacc    780
agatcaaggg cactaaaaga actagagcag ctcaaaaaag cgtctaattc caaagaggac    840
atttccatta acgatttgat ttgtatacat cctatgtatg caagaaaga gcacgaaatt    900
atcaaaatgc ctcatcttat gaattagac gggttgagcg tttcatacaa aggcgaagct    960
gttttggaaa atctgcactg gaaagttcag ccgggttcga aatggcatat aagaggtgac   1020
aatgggtcag gtaagtcgac cttattatct ttgcttacgg cggaacatcc ccaatcgtgg   1080
aattcgaggg tgatagataa tggcgtccca cgaagaacag gtaaaacaaa ctactttgac   1140
ctaaacagca aaataggtat gtcatcaccc gaattacacg caattttttt gaagaatgct   1200
ggaggaaggc taaacattcg ggaaagtgtt gcaactggct atcatgaggc gtcctccaac   1260
aattacctac ccatatgaa gcgcttggac aaaaatagcc aagaaatagt gaatatgtat   1320
ctgaaatatt ttggcctgga caaagacgcc gatagtgttt tatttgaaca gttgtccgta   1380
agtgaccaga aactagtcct tttttgtcagg tctttaatta agatgccgca aatattgatt   1440
ctcgatgagg cattttctgg aatggaggta gaacctatga tgcgttgtca tgaattttta   1500
gaggagtggc ctggaacagt ccttgtagtg gcacacgttg ccgaagagac accaaaatgt   1560
gcccattact taaggctcat atctcctgga gagtatgaaa taggcgatat ggaaaattaa   1620

SEQ ID NO: 90
MSTNKFVVRI TNALFKSSLA SNSPPVYPKR IRHFEILPNE KWVIWGPGKG KFLDVLNNKY     60
ICEPPLSLRF GFLKESSNIL PRIEQVAFKG VMPTAHLSAR YEYFKDDYDQ TCKQFIFDKA    120
SGSNAVSYKV ETNNRQINME LYNALVENLN LSSLQDRWVM GLSNGQMRRA RLARSILKEP    180
DLLLIDDPFL GLDPAAIATI SQFLAKYDSI EVSGGCPIVI GLRYQDTIPA WCTHICCVDE    240
KNGILFEGPI EKLQSKMDET RSRALKELEQ LKKASNSKED ISINDLICIH PMYGKKEHEI    300
IKMPHLIELD GLSVSYKGEA VLENLHWKVQ PGSKWHIRGD NGSGKSTLLS LLTAEHPQSW    360
NSRVIDNGVP RRTGKTNYFD LNSKIGMSSP ELHAIFLKNA GGRLNIRESV ATGYHEASSN    420
NYLPIWKRLD KNSQEIVNMY LKYFGLDKDA DSVLFEQLSV SDQKLVLFVR SLIKMPQILI    480
LDEAFSGMEV EPMMRCHEFL EEWPGTVLVV AHVAEETPKC AHYLRLISPG EYEIGDMEN     539

SEQ ID NO: 91
atggctggta atcttgtttc atgggccctgc aagctctgta gatctcctga agggtttgga     60
cctatatcct tttacggtga ctttactcaa tgcttcatcg acggtgtgat cctaaatcta    120
tcagcaattt tcatgataac cttccggtatc agagatttag ttaacctttg caagaaaaaa    180
cactctgcca tcaaatatag gcggaattgg attattgtct ctaggatggc actagttctg    240
ttggagatag cgtttgtttc acttgcgtct taaatatatt ctaaagaaga acggaaaac    300
ttttaccattg taagtcaata tgcttctaca atgttatctt tatttgttgc tttagcctta    360
cactggatag aatacgatag atcagttgta gccaatacgg tacttttatt ctattggctt    420
tttgaaacat tcggtaattt tgctaaacta ataaatattc taattagaca cacctacgaa    480
ggcatttggt attccggaca aacgggtttc atactaacgt tattccaagt aataacatgt    540
gccagtatcc tgttacttga agctcttcca aagaagccgc taatgccaca tcaacacata    600
```

TABLE 3-continued

Sequences disclosed herein.

```
catcaaactt taacaagaag aaaaccaaat ccatacgata gcgcaaacat attttccagg    660
attaccttct cttggatgtc aggtttgatg aaaactggct atgaaaaata cttagtggaa    720
gcagatttat ataaattacc gaggaacttt agtagtgaag aactctctca aaaattggag    780
aaaaactggg aaaatgagtt gaagcaaaaa tcaaatcctt cattatcatg ggctatatgc    840
agaactttg gatctaaaat gcttttagcc gcattcttta aagcaattca tgatgttcta     900
gcatttactc aaccacaact actaaggatt ttaatcaagt tcgtcacaga ctataacagt    960
gagagacagg atgaccattc ttctcttcaa gggtttgaaa ataaccaccc acaaaaatta   1020
cccattgtaa gagggttttt gattgcgttt gctatgtttc tggtgggctt tactcagaca   1080
tctgtcctgc atcaatattt cctgaatgtc ttcaacacag gcatgtatat taagagcgcc   1140
ctaacgcgtt taatatatca aaaatcctta gtgctatcta atgaggcttc tggacttcc    1200
tctaccggtg acattgtcaa tctcatgagt gtggatgttc aaaaattaca agattaaca    1260
caatggctaa atttaatatg gtcagggcct tttcaaatca ttatttgctt atattctctg   1320
tataagttgt ggaaaattc catgtgggtt ggcgtgatta tactagtat tatgatgcca     1380
ttgaactcat ttttgatgag gatacaaaag aagttgcaaa atcccagat gaagtacaaa    1440
gatgaaagga cccgtgttat aagtgaaata ctaaacaata ttaaatcttt gaagttatat   1500
gcatgggaga agccttatag ggaaaagcta gaagaagtaa gaaataacaa agagttaaaa   1560
aatcttacaa aactaggatg ttatatggct gtgacaagtt ttcagttcaa tatagtacca   1620
ttccttgttt catgttgtac ctttgctgta tttgttata ctgaggatag agcattgact    1680
actgacttag ttttccctgc tttgactctg ttcaacctgc tctcattccc actaatgatt   1740
attcctatgg tttaaattc ttttatcgaa gcttctgttt ctattggtag attatttaca    1800
ttctttacca atgaagagct acaaccagat tcggttcagc gttaccaaa agtaaaaaat   1860
attggcgatg tagccattaa cattggagat gatgctacct ttttatgcaa acggaaaccg   1920
gaatacaaag tagccttaaa gaatattaat tccaagcta aaaaaggaaa tttgacctgt    1980
attgttggta aagttggcag tggtaaaaca gctctattgt catgcatgtt aggtgatcta   2040
ttcagggtta aaggtttcgc caccgttcat ggttctgttg cttatgtttc acaagttcca   2100
tggataatga atggtactgt aaaggaaaac attttatttg ggcatagata cgacgcggaa   2160
ttttacgaaa aaacgatcaa ggcctgtgcg ttaactattg atcttgcaat tttgatggat   2220
ggagataaga cattagttgg cgagaaaggg atctccttat ctggaggaca aaaagctcgt   2280
ttgtctttag caagagcagt ttatgcgaga gctgacactt atttacttga tgatcctttg   2340
gcagctgttg atgaacacgt tgccaggcac ttgatcgaac atgtgttggg tccaaatggt   2400
ttattacata caaaaacgaa ggtattagcc actaataagg tgagcgcgtt atccatcgca   2460
gattctattg cattattaga taatggagaa atcacacagc agggtacata tgatgagatt   2520
acgaaggacg ctgattcgcc attatgaaa ttgctcaaca actatggtaa aaaaaataac    2580
ggtaagtcga atgaattcgg tgactcctct gaaagctcag ttcgagaaag tagtataccct  2640
gtagaaggag agctggaaca actgcagaaa ttaaatgatt tggattttgg caactctgac   2700
gccataagtt taaggagggc cagtgatgca acttttgggaa gcatcgattt tggtgacgat  2760
gaaaatattg ctaaaagaga gcatcgtgaa cagggaaaag taaagtggaa catttaccta   2820
gagtacgcta aagcttgcaa cccgaaaagc gtttgtgtat tcatattgtt tattgttata   2880
tcgatgttcc tctctgttat gggtaacgtt tggttgaaac attggtctga agttaatagc   2940
cgctatggat ctaatccaaa tgccgcgcgt tacttggcca tttatttttgc acttggtatt  3000
ggttcagcac tggcaacatt aatccagaca atcgttctct gggtttttg taccattcat    3060
gcctccaaat atttacacaa cttgatgaca aactctgtgt tgagagcccc aatgacgttt   3120
tttgaaacaa caccaatcgg tagaattcta acagattct caaatgacat atacaaagtg    3180
gatgctttat taggaagaac atttttctcag ttttcgtca atgcagtgaa agtcacattc   3240
actattacgg ttatctgtgc gacgacatgg caatttatct tcattatcat tccactaagt   3300
gtgttttaca tctactacca gcagtattac ctgagaacat caagggagtt gcgtcgttta   3360
gactctatta ctaggtctcc aatctactct catttccaag agactttggg tggccttgca   3420
acggttagag gttattctca acagaaaagg ttttcccaca ttaatcaatg ccgcattgaa   3480
aataacatga gtgcgttcta tccctctatc aatgctaacc gttggctagc atataggttg   3540
gaacttattg gttcaattat cattctaggt gctgcaactt tatccgtttt tagactaaaa   3600
caaggcacat taacgcagg tatggtgggt ttatcattaa gctatgcttt acaaatcact    3660
caaacgttaa attggattgt tagaatgact gtggaagttg aaacgaatat tgtttcagtg   3720
gaaagaataa aggaatatgc tgatttgaag agcgaggcac ctttaatagt tgaaggccac   3780
agaccaccca aagaatggcc gagccagggt gatataaagt ttaataatta ttccactcgt   3840
tataggccgg agcttgatct tgttctgaag cacattaata tacacattaa accaaatgaa   3900
aaagttggta tcgtgggtag aacgggtgcg ggaaaatcct cattaacgct agcattattc   3960
aggatgattg aggctagcga gggaaacatc gtaatcgaca acattgccat caacgagatt   4020
gggttatatg atttgagaca taaattgtca atcatacctc aggattctca agttttgag    4080
ggcactgttc gtgagaacat tgatcccatt aaccaataca ctgatgaagc tatttggagg   4140
gcattggaac tttctcattt gaaagaacac gtgctatcaa tgagcaatga cggattagat   4200
gcccaactaa ccgaaggtgg tggcaactta agtgttgaac aaagacaatt attatgtcgt   4260
gcaagagcaa tgttggttcc atcaaagatt ttggtgcttg atgaagccac ggccgcagtc   4320
gacgtggaga cagataaagt cgtccaagag acgattcgta ctgctttcaa ggacagaact   4380
atcttgacca tcgcgcatag actgaacacg ataatggaca gtgatagaat catagtgttg   4440
gacaatggta aagtagccga gtttgactct ccgggccagt tattaagtga taacaaatca   4500
ttgttctatt cactgtgcat ggaggctggt ttggtcaatg aaaattaa                4548

SEQ ID NO: 92
MAGNLVSWAC KLCRSPEGFG PISFYGDFTQ CFIDGVILNL SAIFMITFGI RDLVNLCKKK     60
HSGIKYRRNW IIVSRMALVL LEIAFVSLAS LNISKEEAEN FTIVSQYAST MLSLFVALAL   120
HWIEYDRSVV ANTVLLFYWL FETFGNFAKL INILIRHTYE GIWYSGQTGF ILTLFQVITC   180
ASILLLEALP KKPLMPHQHI HQTLTRRKPN PYDSANIFSR ITFSWMSGLM KTGYEKYLVE   240
ADLYKLPRNF SSEELSQKLE KNWENELKQK SNPSLSWAIC RTFGKMLLA AFFKAIHDVL    300
AFTQPQLLRI LIKFVTDYNS ERQDDHSSLQ GFENNHPQKL PIVRGFLIAF AMFLVGFTQT   360
SVLHQYFLNV FNTGMYIKSA LTALIYQKSL VLSNEASGLS STGDIVNLMS VDVQKLQDLT   420
QWLNLIWSGP FQIIICLYSL YKLLGNSMWV GVIILVIMMP LNSFLMRIQK KLQKSQMKYK   480
DERTRVISEI LNNIKSLKLY AWEKPYREKL EEVRNNKELK NLTKLGCYMA VTSFQFNIVP   540
FLVSCCTFAV FVYTEDRALT TDLVFPPALTL FNLLSFPLMI IPMVLNSFIE ASVSIGRLFT   600
```

TABLE 3-continued

Sequences disclosed herein.

```
FFTNEELQPD SVQRLPKVKN IGDVAINIGD DATFLWQRKP EYKVALKNIN FQAKKGNLTC      660
IVGKVGSGKT ALLSCMLGDL FRVKGFATVH GSVAYVSQVP WIMNGTVKEN ILFGHRYDAE      720
FYEKTIKACA LTIDLAILMD GDKTLVGEKG ISLSGGQKAR LSLARAVYAR ADTYLLDDPL      780
AAVDEHVARH LIEHVLGPNG LLHTKTKVLA TNKVSALSIA DSIALLDNGE ITQQGTYDEI      840
TKDADSPLWK LLNNYGKKNN GKSNEFGDSS ESSVRESSIP VEGELEQLQK LNDLDFGNSD      900
AISLRRASDA TLGSIDFGDD ENIAKREHRE QGKVKWNIYL EYAKACNPKS VCVFILFIVI      960
SMFLSVMGNV WLKHWSEVNS RYGSNPNAAR YLAIYFALGI GSALATLIQT IVLWVFCTIH     1020
ASKYLHNLMT NSVLRAPMTF FETTPIGRIL NRFSNDIYKV DALLGRTFSQ FFVNAVKVTF     1080
TITVICATTW QFIFIIIPLS VFYIYYQQYY LRTSRELRRL DSITRSPIYS HFQETLGGLA     1140
TVRGYSQQKR FSHINQCRID NNMSAFYPSI NANRWLAYRL ELIGSIIILG AATLSVFRLK     1200
QGTLTAGMVG LSLSYALQIT QTLNWIVRMT VEVETNIVSV ERIKEYADLK SEAPLIVEGH     1260
RPPKEWPSQG DIKFNNYSTR YRPELDLVLK HINIHIKPNE KVGIVGRTGA GKSSLTLALF     1320
RMIEASEGNI VIDNIAINEI GLYDLRHKLS IIPQDSQVFE GTVRENIDPI NQYTDEAIWR     1380
ALELSHLKEH VLSMSNDGLD AQLTEGGGNL SVGQRQLLCL ARAMLVPSKI LVLDEATAAV     1440
DVETDKVVQE TIRTAFKDRT ILTIAHRLNT IMDSDRIIVL DNGKVAEFDS PGQLLSDNKS     1500
LFYSLCMEAG LVNEN                                                     1515

SEQ ID NO: 93
atgacgcttg gtaatagacg ccatgggcgg aataatgagg gaagctctaa tatgaatatg       60
aatcgtaacg accttgacga tgtttcccat tacgagatga aggaaataca accaaaggaa      120
aaacaaattg gctctataga accggaaaat gaagtagaat attttgaaaa acagtggaa       180
aaaaccattg aaaatatgga atatgaaggt gaacatcatg catcttactt acggaggttc      240
attgactcgt ttagaagagc ggaaggctcg catgcaaatt ccccagactc gagcaactct      300
aatgggacta ctcctatatc cacaaaagat tccagctctc aattggacaa tgagttgaat      360
cggaagagct catacatcac tgttgatggt attaaacagt caccacaaga acaagaacag      420
aaacaagaaa atttgaaaaa gagtataaag ccccgtcata cggtgatgat gtccctaggg      480
actggtattg gtactggttt gctggtcggt aactccaaag ttttgaacaa tgcaggtccg      540
ggtgggttga tcattggtta tgctattatg ggtagttcgg tttactgtat tattcaagct      600
tgtggtgaat tagcggttat atacagtgat ttgattggtg gatttaatac atatcctttg      660
ttttttggtcg accctgcact tggctttctt gttgcttggc tttttttgctt acaatggcta    720
tgtgtttgtc ctctagaatt ggtcactgca tccatgacta tcaaatattg gacgacatct      780
gtgaacccgg atgttttcgt tgttatcttc tacgtactaa tcgttgttat caacgtttt       840
ggagctaagg gttatgcaga ggcagatttc ttcttcaatt gttgtaaaat tctgatgata      900
gttggatttt tcattctcgc cattattatt gattgtggtg gtgcaggtac cgatggttac      960
ataggtagca aatattggcg tgatcccgga gccttccgtg tgatacacc catccagagg      1020
ttcaaaggtg tcgttgccac atttgtcaca gcagcgttcg cctttggtat gagtgaacag     1080
ctggctatga ctgccagtga acaatccaat ccaagaaagg ctattccatc ggcggcaaag     1140
aaaatgattt atagaattct gtttgtgttc ttggcgtctt taacgttagt tggtttcctt     1200
gtaccttaca cctcagatca attgctaggg gccgcaggtt cagccactaa agcgtcgccc     1260
tacgtcatcg ctgtctcctc tcatggtgtt cgtgtggttc ctcattttcat aaacgctgtc    1320
atcctgttgt ctgttctttc cgttgctaac ggtgccttca taccagttc tcgtatttt      1380
atgtcgttgg ccaaacaagg taatgcaccc aaatgtttcg attacatcga tagggaaggt     1440
agacctgctg ctgctatgct tgtcagtgca ttatttggtg tcattgcatt ctgtgcctca     1500
tctaaaaagg aagaggacgt tttcacctgg ttgttagcaa tctccggttt gtctcaatta     1560
ttcacgtgga ttaccatttg tttgtctcac attaggttta gaagagctat gaaagtgcaa     1620
ggaaggtcct taggagaggt tggttataaa tctcaagtcg gtgtctgggg gtcggcttac     1680
gctgtcctta tgatggtgtt agctttaatc gcccaatttt gggttgccat tgccccaatt     1740
ggtggaggag gtaagttaag tgcccaatca ttttttgaga attatttggc tatgccaatc     1800
tggattgctt tatacatctt ttacaaagtt tggaaaaaag attggagttn attcattccc     1860
gctgataaag tagacttagt ttctcataga aacatctttg atgaagaatt attaaaacaa     1920
gaagatgaag aatataaaga gagattaaga acggaccat actggaaaag agttcttgat     1980
ttctggtgtt aa                                                        1992

SEQ ID NO: 94
MTLGNRRHGR NNEGSSNMNM NRNDLDDVSH YEMKEIQPKE KQIGSIEPEN EVEYFEKTVE       60
KTIENMEYEG EHHASYLRRF IDSFRRAEGS HANSPDSSNS NGTTPISTKD SSSQLDNELN      120
RKSSYITVDG IKQSPQEQEQ KQENLKKSIK PRHTVMMSLG TGIGTGLLVG NSKVLNNAGP      180
GGLIIGYAIM GSCVYCIIQA CGELAVIYSD LIGGFNTYPL FLVDPALGFS VAWLFCLQWL      240
CVCPLELVTA SMTIKYWTTS VNPDVFVVIF YVLIVVINVF GAKGYAEADF FFNCCKILMI      300
VGFFILAIII DCGGAGTDGY IGSKYWRDPG AFRGDTPIQR FKGVVATFVT AAFAFGMSEQ      360
LAMTASEQSN PRKAIPSAAK KMIYRILFVF LASLTLVGFL VPYTSDQLLG AAGSATKASP      420
YVIAVSSHGV RVVPHFINAV ILLSVLSVAN GAFYTSSRIL MSLAKQGNAP KCFDYIDREG      480
RPAAAMLVSA LFGVIAFCAS SKKEEDVFTW LLAISGLSQL FTWITICLSH IRFRRAMKVQ      540
GRSLGEVGYK SQVGVWGSAY AVLMMVLALI AQFWVAIAPI GGGGKLSAQS FFENYLAMPI      600
WIALYIFYKV WKKDWSLFIP ADKVDLVSHR NIFDEELLKQ EDEEYKERLR NGPYWKRVLD      660
FWC                                                                  663

SEQ ID NO: 95
atgaataatg agacaataa acgacatta gaaaactcaa aaaatgcgtc actagctaat         60
ggaaattatg cgattcccac aaaactaaat aggctgaaaa agaatgctga ccctagagtt      120
gctgcaattt caggtgcttt atctggtgca ctatccgcaa tgctggtctg tccttttgac      180
gttgcgaaaa caagattaca agcacaaggt ctccaaaaca tgacacacca agtcaacat       240
tataagggt tttttggtac atttgctact attttcaaag atgaaggtgc tgctgggctt       300
tataaggtc tacagccgac ggttttaggt tatattccta ctttgatgat ttacttttcc      360
gtctatgatt tctgtagaaa atattcggtc gatatttcc cacatagtcc gtttctctca      420
aacgcttctt ctgcaattac tgcaggtgcc atctctacag ttgcgacaaa tccgatttgg     480
gtagtaaaaa caagacttat gctgcaaaca ggatccggta atattccac ccattataag     540
ggtaccatag acacattag aaagatcatt caacaagagg gtgctaaggc tctttatgcc     600
```

TABLE 3-continued

Sequences disclosed herein.

```
ggcttagtac cagccctgct ggggatgctg aacgttgcta tacagtttcc tttatatgaa    660
aatttaaaaa taaggttcgg atattcagaa tcgactgacg tatcgacaga tgtgacgagc    720
tcaaactttc aaaaattaat attggcctct atgctatcta aaatggtagc atctaccgtg    780
acttatcctc acgaaatact tcgaactcga atgcaactga aatccgatct tccaaatact    840
gttcaacgcc atctccttcc attgattaaa attacgtata ggcaagaggg cttcgccggc    900
ttttactctg ggtttgcaac taatttggta aggacagtac ctgctgctgt ggtaacacta    960
gtatcgtttg aatattctaa aaagtattta actacttttt ttcaataa                1008

SEQ ID NO: 96
MNNGDNKTTL ENSKNASLAN GNYAIPTKLN RLKKNADPRV AAISGALSGA LSAMLVCPFD     60
VAKTRLQAQG LQNMTHQSQH YKGFFGTFAT IFKDEGAAGL YKGLQPTVLG YIPTLMIYFS    120
VYDFCRKYSV DIFPHSPFLS NASSAITAGA ISTVATNPIW VVKTRLMLQT GIGKYSTHYK    180
GTIDTFRKII QQEGAKALYA GLVPALLGML NVAIQFPLYE NLKIRFGYSE STDVSTDVTS    240
SNFQKLILAS MLSKMVASTV TYPHEILRTR MQLKSDLPNT VQRHLLPLIK ITYRQEGFAG    300
FYSGFATNLV RTVPAAVVTL VSFEYSKKYL TTFFQ                               335

SEQ ID NO: 97
atggtttccc aatttgctat tgaggtgcgt aacctaacgt acaaattcaa agaaagctcc     60
gatccgtcag ttgttgatat caatcttcaa atcccatgga atacaagatc tttagttgtg    120
ggtgccaatg gtgctggtaa atccacccct ttgaaattac taagcggtaa gcatctttgc    180
cttgatggaa aaatcctggt caatggtctt gatccattca gtccattatc tatgaatcaa    240
gtggacgatg atgaaagtgt tgaagattcg acgaactacc aaacgaccac ttatctaggt    300
acggaatggt gccatatgag tatcattaat agggatatcg gcgtcttgga actattaaaa    360
agtattggat tcgatcattt tagggaaaga ggtgaaagat tggttagaat cctggacatc    420
gatgtacgtt ggagaatgca caggttaagt gatggacaaa agagaagagt tcagttagcc    480
atggggctct tgaaacccttg gagagtttta ctacttgatg aggtcactgt ggatctcgat    540
gttattgcca gagcaagact tctggagttt ttaaagtggg agaccgaaac cagaagatgc    600
tcagtggtct acgctacaca tattttgac ggcttggcca aatggcctaa ccaagtatac    660
catatgaaat caggtaagat tgtggataat ttagattatc agaaagacgt agagttctct    720
gaagtggtca atgctaaagt taatggacaa gtggccttttg aaaatgacaa caataaggtt    780
gttattagta aagtgaatag tttgcatcca ttagcactag aatggttgaa acgtgataat    840
caaattcctg acaaagagat tggtatataa                                     870

SEQ ID NO: 98
MVSQFAIEVR NLTYKFKESS DPSVVDINLQ IPWNTRSLVV GANGAGKSTL LKLLSGKHLC     60
LDGKILVNGL DPFSPLSMNQ VDDDESVEDS TNYQTTTYLG TEWCHMSIIN RDIGVLELLK    120
SIGFDHFRER GERLVRILDI DVRWRMHRLS DGQKRRVQLA MGLLKPWRVL LLDEVTVDLD    180
VIARARLLEF LKWETETRRC SVVYATHIFD GLAKWPNQVY HMKSGKIVDN LDYQKDVEFS    240
EVVNAKVNGQ VAFENDNNKV VISKVNSLHP LALEWLKRDN QIPDKEIGI               289

SEQ ID NO: 99
atgtctagac aagacgaaaa ttctgcttta ctagcgaata tgaaaataa caaaccatcg      60
tatacggaaa atgagaacgg agtctacgat aatttcaaat tatcaaaaag tcaactttcg    120
gatcttcata accctaaatc aataagatca tttgtcagat tatttggata tgagtctaac    180
agcctcttca aatacttgaa aacagataaa aatgcaggca tttctcttcc agaaatatca    240
aattatcgaa agacaaaccg gtataaaaat tatggcgata attcacttcc tgaaagaata    300
ccaaagtctt ttttacaatt agtatgggct gcttttaatg acaaaacaat gcaattactg    360
acagtcgccg ctgttgtttc cttttgtttta ggtctatacg aactatggat gcaacctaca    420
cagtatgatc ctgaaggaaa taaaattaag caagttgact ggattgaagg ggttgctatc    480
atgattgcgg tctttgtggt agttctagtg agtgccgcta acgattacca gaaggagttg    540
caatttgcaa agctaaataa aaagaaggaa accgtaaaa ttatagtcat aagaaatgat    600
caggaaatat taatttccat tcaccacgtt ttagtcggtg atgtcatttc attacaaacc    660
ggtgatgttg tccccgctga ttgtgttatg atatcaggga agtgtgaggc agatgaatca    720
tccatcactg gtgaatctaa cacaatacag aaatttccgg tggataactc attaagagat    780
ttcaaaaaat ttaattctat cgatagtcat aaccatagca aaccattaga tataggtgac    840
gttaacgaag acgtaacaa gattgctgat tgtatgttga tttcaggttc cagaattctc    900
tctggcttgg gcaggggtgt catcacgtcc gtgggtataa actcagttta cggtcaaacc    960
atgacttcat taaatgccga acctgaaagt actccattca agttacttt gagccaattg   1020
gctgataata tatccgttta cggttgcgtg tctgctataa ttcttttctt ggtccttttc   1080
actaggtact tattttacat aatacctgag gatggcaggt tccatgatct agatcccgct   1140
caaaagggtt ctaaatttat gaacattttt atcacatcta tcacggttat tgtggtggtt   1200
gttccggaag gtttaccatt agctgtaact ttggccttag cgtttgcaac aacaagaatg   1260
acaaaagacg gtaatttagt acgggttta agaagctgtg aaacgatggg atctgctact   1320
gcagtgtgct ctgataagac tggcactttg acagaaaatg tcatgactgt cgttcgtggc   1380
ttcccgggca attctaaatt tgatgatagt aaatgtttcc ccgttagcga acaaaggaag   1440
ctgaattcta agaaagtttt tgaagaaaat tgttcgtcat ccttgagaaa tgatttatta   1500
gccaatattg tcctgaattc taccgccttc gaaacagag attataagaa aacgataaa    1560
aatacaaatg gtagtaaaaa tatgtcaaaa aatttgagtt tttagataa gtgtaaatct   1620
agattatcgt ttttaaaaa aggcaacagg gaagatgacg aggatcaatt attcaaaaat   1680
gtcaacaagg gtaggcaaga acccttattt ggctctaaaa cggaaacagc cttactcagt   1740
ttggcaagat tatcattagg attacaaccg ggagaattgc aatatttgag agatcaaccg   1800
atggaaaagt ttaatatcga aaagttgtt caaacaattc cgtttgaaag ttctcgtaaa   1860
tgggccggct tgtggtaaa ggcaaaaata gcaaaaata aaaaccatt ttacaggttt   1920
ttcattaaag gtgcagcaga aattgttttcc aagaattgtt cgtacaagga gaattcagat   1980
gatactttgg aagaaatcaa tgaggacaat aaaaaagaaa ctgatgatga aatcaaaaat   2040
cttgcgtccg atgctctcag agccataagt gttgcccaca agatttctg cgaatgtgat   2100
agctggcccc ctgaacagct gcgtgataaa gactcaccaa atatagctgc tcttgacttg   2160
ctatttaaca gtcaaaaggg cttaattcta gatggttac ttgggattca agacccttta   2220
```

TABLE 3-continued

Sequences disclosed herein.

```
cgtgcaggcg ttagggagtc agtacaacag tgccaacgtg ctggtgtaac tgtgcgtatg   2280
gttactggtg acaatatatt aacagcaaaa gcaatcgcga ggaattgtgc gattctttct   2340
actgatatta gttcagaggc ttattctgca atggaaggca ctgaattcag aaagttaacg   2400
aaaaacgaac gtataagaat cctgccaaat ttaagggtct tagcaaggtc ttcgcctgag   2460
gataaaaggt tattagtaga aacattgaag gggatgggag atgttgttgc ggtcactggc   2520
gatggtacga acgatgctcc agctttaaag ctagctgatg ttggtttctc aatgggtatt   2580
tccggtacgg aggttgccag agaggcttct gacattattt tgatgactga tgatttctca   2640
gctattgtca acgctattaa gtggggaaga tgtgtttcag tctccataaa aaagttcata   2700
cagtttcaat taattgttaa tatcaccgca gtgattttaa cgttcgtttc atccgttgca   2760
tctagtgatg aaacatcagt actgacggcg gtccaactgt tatggatcaa tctaatcatg   2820
gatactctag cagctttagc tttagccact gataaacccg atccaaatat catggacaga   2880
aaacctaggg gccgctcaac ttctttgatt tctgtgtcaa cttggaaaat gattctatca   2940
caagctcact tgcagttgat agttactttc attttgcatt tttacgggcc agagttattc   3000
ttcaagaaac atgaagatga aataacaagt caccaacagc agcaactgaa tgccatgaca   3060
ttcaacactt ttgttttggt gcaattttt accatgttag tatcgagaaa attagatgaa    3120
ggtgatggta tatcaaactg gagaggcagg atttctgccg ccaatttgaa tttcttccaa   3180
gacttgggta gaaactatta ttttctcacg atcatggcga tcattggcag ctgtcaagtt   3240
ttaatcatgt tttttggtgg cgcaccattt tctattgcca gacaaaccaa atcaatgtgg   3300
ataaccgcgg tactgtgtgg tatgttgtct ctaatcagtg ggtgctagt gagaatctgc    3360
cccgatgaag tagcagtgaa ggtatttccg gctgctttcg ttcaaagatt caagtacgta   3420
tttggactcg agttcctcag aaaaaaccat actggaaaac acgacgatga agaagcgctg   3480
ttggaggaat ctgatagtcc agagtccacc gccttttatt aa                      3522
```

SEQ ID NO: 100

```
MSRQDENSAL LANNENNKPS YTGNENGVYD NFKLSKSQLS DLHNPKSIRS FVRLFGYESN     60
SLFKYLKTDK NAGISLPEIS NYRKTNRYKN YGDNSLPERI PKSFLQLVWA AFNDKTMQLL    120
TVAAVVSFVL GLYELWMQPP QYDPEGNKIK QVDWIEGVAI MIAVFVVVLV SAANDYQKEL    180
QFAKLNKKKE NRKIIVIRND QEILISIHHV LVGDVISLQT GDVVPADCVM ISGKCEADES    240
SITGESNTIQ KFPVDNSLRD FKKFNSIDSH NHSKPLDIGD VNEDGNKIAD CMLISGSRIL    300
SGLGRGVITS VGINSVYGQT MTSLNAEPES TPLQLHLSQL ADNISVYGCV SAIILFLVLF    360
TRYLFYIIPE DGRFHDLDPA QKGSKFMNIF ITSITVIVVA VPEGLPLAVT LALAFATTRM    420
TKDGNLVRVL RSCETMGSAT AVCSDKTGTL TENVMTVVRG FPGNSKFDDS KSLPVSEQRK    480
LNSKKVFEEN CSSSLRNDLL ANIVLNSTAF ENRDYKKNDK NTNGSKNMSK NLSFLDKCKS    540
RLSFFKKGNR EDDEDQLFKN VNKGRQEPFI GSKTETALLS LARLSLGLQP GELQYLRDQP    600
MEKFNIEKVV QTIPFESSRK WAGLVVKYKE GKNKKPFYRF FIKGAAEIVS KNCSYKRNSD    660
DTLEEINEDN KKETDDEIKN LASDALRAIS VAHKDFCECD SWPPEQLRDL DSPNIAALDL    720
LFNSQKGLIL DGLLGIQDPL RAGVRESVQQ CQRAGVTVRM VTGDNILTAK AIARNCAILS    780
TDISSEAYSA MEGTEFRKLT KNERIRILPN LRVLARSSPE DKRLLVETLK GMGDVVAVTG    840
DGTNDAPALK LADVGFSMGI SGTEVAREAS DIILMTDDFS AIVNAIKWGR CVSVSIKKFI    900
QFQLIVNITA VILTFVSSVA SSDETSVLTA VQLLWINLIM DTLAALALAT DKPDPNIMDR    960
KPRGRSTSLI SVSTWKMILS QATLQLIVTF ILHFYGPELF FKKHEDEITS HQQQQLNAMT   1020
FNTFVWLQFF TMLVSRKLDE GDGISNWRGR ISAANLNFFQ DLGRNYYFLT IMAIIGSCQV   1080
LIMFFGGAPF SIARQTKSMW ITAVLCGMLS LIMGVLVRIC PDEVAVKVFP AAFVQRFKYV   1140
FGLEFLRKNH TGKHDDEEAL LEESDSPEST AFY                                1173
```

SEQ ID NO: 101

```
atgcctcaat ctactccaag tcaagaagta cagcgtgtac catgggataa taaacctgct     60
ttgaagcaga taacactccg agcaaccata gcaggtatgc ctatagggtc tctggtgcta    120
acatcaaatt ttcaatttgg cctgcaaacc ggttgggttt ccatgatgtc cctgccatcg    180
gcattgttag cttgtgcttt cttaaaaat atctggccat taatatttcc gaacgacagg     240
cctttcagtg acgttgaaaa tgtatacgta caaagtatgg cagtagctgt cggaacaggc    300
ccattagcct ttgggtttgt cggcgtcata cctgccatgc agaagttcct tactaacgac    360
gaaagtggtg gattaaggga acaaggacag tccttcactt ttagagaatt gttaatatgg    420
tccacagccc tagcattctt cggtattttt tttgcagttc ctctaagaaa gcaagtaatt    480
gttagagaga aacttccctt ccccagtggt agcgccacgg ccactttaat ttcagtgcta    540
aatggaactg agattttaca agaggtttct aagtcagagt tattggaaat gaggcagagg    600
agattgaatg aatgccctga agtgctacaa cccaacagag atccagagga ggcggattat    660
ttaatgaact cttctcatag cgaacttggt gattatacgg caactagcca agatggaagt    720
tctatccttt ctactggctc tgagaactac agagcgaata ttattatttt attgaaaact    780
tttgttgttt cttcgcttta caccatggtg tcatattttg taccggtaat acggtctatt    840
ccagtcttcg gaaaatacct ctcgaacaat tatctctgga attttcagcc gtcgcctgcg    900
tatataggcc aagggataat aatgggtctt ccaacagtat cgtatatgct tatcgggtgc    960
ttcttaggct ggggtgtgtt agcaccattg gcgagataca aaagatgggt accaccagat   1020
gctgatgtcc acgactggga ggaggagtg caaggatgga ttctttggtc gtcgctttca    1080
ataatggttg ctgacagtgt agtcgctttt attgttgtga cagtgaagtc cattgtgaaa   1140
tttattctta tagatgacaa agctgcttta ctgaacaaca taatcgatga tacatttcaa   1200
tctatgttac tggaggagga acgcgccatt aatagcagca aagaaatac atatgttgat    1260
ggaaggcagg acaccgtaag aattagtgagt agagataacg aaatagaagt agattcgaag   1320
catttggttc gctataccac cgttatcagt ggatgtctag tctcctcgat aatatgcatt   1380
gtttccataa tatatttgtt tgggatacaa gtaattcccc tatatgctat tatcactgct   1440
ttgatacttg cgttgtttct atctattctc ggtattcgag cacttggaga accgatctg     1500
aatcctgtga gcggcattgg taagatctct caattgattt ttgcctttat cataccaagg   1560
gatagaccga atcagtgtt aatgaacgtg gtattgcaga gctctctgcc                1620
caacaggcgg gcgatttaat gcaggatttg aaaacggggc acctcctcgg cgcctcccca   1680
agagctcagt tctgtgccca attgataggg gcctgttggt caattatttt gtctagcttc   1740
atgtatttgt gctacaataa agtttattca attccgagtg agcaattcag gataccgaca   1800
gcagtagtgt ggatagattg tgcaagacta gtaactggta aagggctccc tgataaggcc   1860
ttggagtgct ccatgattct cggagtcata tttgccgttt tatcattaat cagaaacact   1920
```

TABLE 3-continued

Sequences disclosed herein.

```
tatagagatt acggatacgg gtggatatta tatattccgt ctggtgtagc agtcggtgtt   1980
ggtatattta attctcccag ttttacaatt gcaagattca tcggcgggtg ggcttcgcat   2040
ttttggttga agaatcatag gggtgactta aatgcgaaaa caaaaatgat tgtattcagt   2100
tcggggttgg tcttaggtga aggtatcttt agcgtaataa acatgctctt catctgctta   2160
aatgtccctc actattag                                                2178

SEQ ID NO: 102
MPQSTPSQEV QRVPWDNKPA LKQITLRATI AGIAIGSLVL TSNFQFGLQT GWVSMMSLPS     60
ALLACAFFKN IWPLIFPNDR PFSDVENVYV QSMAVAVGTG PLAFGFVGVI PAIEKFLTND    120
ESGGLREQGQ SFTFRELLIW STALAFFGIF FAVPLRKQVI VREKLPFPSG SATATLISVL    180
NGTEILQEVS KSELLEMRQR RLNECPEVLQ PNRDPEEADY LMNSSHSELG DYTATSQDGS    240
SILSTGSENY RANIIILLKT FVVSSLYTMV SYFVPVIRSI PVFGKYLSNN YLWNFQPSPA    300
YIGQGIIMGL PTVSYMLIGC FLGWGVLAPL ARYKRWVPPD ADVHDWEEGV QGWILWSSLS    360
IMVADSVVAF IVVTVKSIVK FILIDDKAAL LNNIIDDTFQ SMLLEEERAI NSSRRNTYVD    420
GRQDTVRLVS RDNEIEVDSK HLVRYTTVIS GCLVSSIICI VSIIYLFGIQ VIPLYAIITA    480
LILALFLSIL GIRALGETDL NPVSGIGKIS QLIFAFIIPR DRPGSVLMNV VSGGIAEASA    540
QQAGDLMQDL KTGHLLGASP RAQFCAQLIG ACWSIILSSF MYLCYNKVYS IPSEQFRIPT    600
AVVWIDCARL VTGKGLPDKA LECSMILGVI FAVLSLIRNT YRDYGYGWIL YIPSGVAVGV    660
GIFNSPSFTI ARFIGGWASH FWLKNHRGDL NAKTKMIVFS SGLVLGEGIF SVINMLFICL    720
NVPHY                                                                725

SEQ ID NO: 103
atgggaagga ctattaggag acgccggagt aattcgtcgc tttcggaggc catatcagtt     60
tctttaggaa taaatcaaga ctcatctgtg aacaagatgc atagagcgag tgttagcgca    120
atgtctcctc cattatgccg ttcatacatg agcggatttt ttactggtgg aaactcacct    180
atgatcaata atttgtcgga ttcaaaactt cccatctcga acaaacaaca tcctaaagtg    240
atacatggat cagaaaattt gcataggcag acagctcaac tatccaatga attttgctcc    300
tcttctgtgg aagaaaattc tcccacaatt aaggattaca tggacattat aggcaatggt    360
gatagaaaag atgatcaatc tatgcgtact atagaagaga atattgatga agaatattca    420
gatgagtact ccagattgct acttagccca gcatcgtcta acgtgtgacga tgaccgaaat    480
cgaggactac agaatagttc actaccggaa ttagaagatg gttacgcggg cggatatcag    540
tcacttcgtc cctcccataa tttaaggttt aggcaagaa acttgtggca tatgtgtacg    600
tcatttcctt ccaaatttgc acattatctg cccgcagcag tgttaggttt gcttttgaac    660
attttagatg ccttatctta tggtatgatc attttttccaa tcacagagcc agttttttct    720
catttaggc ccactggtat atccatgttt tatatttcca ccataatatc acaagccgtg    780
tactccggag gctggtcgag ttttccttcc gggattggga gtgaaatgat tgaaattact    840
ccgttttatc atacaatggc attagctata aaagaggcat tagcaggtaa tgatgacgaa    900
atcataacga caacgatatt ttgttatgtg ataagttcga tgctcacagg tgtcgttttc    960
tatgcattgg gtaaactacg actaggaaag atagtgggat ttttttccacg acacatattg   1020
attggctgta ttggaggtgt tggttatttc ttgataatta caggaattga agtcacaacg    1080
agggtggcga aatttgaata ttcatggcct ttttttttcag ggctgtttac ggattatgac   1140
acattagcga aatggttatt acctgtacta ttgactgtag ttttaatcgg cactcaacgc    1200
tactttaaga actcactcgt tttgccaagt ttttacatct tgacgttagt tttgtttcat    1260
tttattgttg cgatcattcc aacattatcc ttggatgctt tgagacaagc tggatggatt    1320
tttcctattg ccaactcaga tagtaaatgg tatgaccatt atagattatt taatgtccat    1380
aaagttcatt ggtcactagt tttgcaacaa ataccaacga tgatggcatt gacatttttt    1440
ggtatcctac atgttcctat aaatgttcct gcgttggcta tgtcactaca aatggataag    1500
tatgatgttg acagagaatt gattgcacat ggttattca acttttttag tggattatta    1560
ggttctgtcc aaaattactt ggtatatacc aacagtgttc tgtttattag ggcgggcgct    1620
gattcgccat tcgctgggtt ccttttaata gctttgacta tctgtattat gatcattgga    1680
ccagtcataa tatcattcat tccaatctgt atagtgggct ctctaatttt cctactaggc    1740
tacgagttat tagtggaagc gttggtcgat acatgaaata aattgaatag attccgaaat    1800
ttgactgttg tcattattgt tttcacgatg ggtatctttg attttgtcct aggtatcatc    1860
gttggcattt taattgcatg ttttttcgttt ttggtggata gtacgaaatt acaaaccatt   1920
aacggtgaat ataatgggaa cgtcgcaaga agtacagtat atcgtgatta cgttcaaaca    1980
aaattttttg atggaattgg tgaacaaata tatgttttaa agctccaaaa ccttctgttt    2040
ttcggaacaa tcatatctat tgaagagaaa attgaaagat tgctgcaaat aagtaacaaa    2100
gatgcaacaa aacgcagaat aaagtattta atattggact ttaaaaatat taatgccgac    2160
aatattgact attctgcggc agaaggtttc aatagaatta aaagattcac ggaaaccaaa    2220
agaatcaaac taatcatatc ttcaatcaaa gaaagggacc gtatttacaa cgccttcaat    2280
aatgtgggat tactaaacga tgtggaatta tttgctgatt taaacagtgc gttggaatgg    2340
tgtgaaaacg aattccttttt tcaatataaa caattaagaa aaaaggcgaa agaaagattg    2400
gaagaaggaa agcaaaataa tgtcgtatcc gcagtaattg cagccactaa aaacaaaaaa    2460
attgataaca taggaaatgg tttaaacagg ggaagcaatg gagacacagc gagaaactta    2520
atgtcactac caaccaatac tcctcgtaat taccaaatac tttctgtagc acagaatgta    2580
tttgtaaacg acgaacaagc agtgaagaat ttcaaaaagg agtacaaaga tgatgaacct    2640
gtcctgccta tattgttatt tgcattaaag cagtaccgac ccgatataat atctgaagtt    2700
caaaaagtaa gagaaaagga aatcaagttt tgggcacaac tctgcccta cttcaccagg    2760
cgcagattag caagtcaatc acattttacta catgcagaca acatttttttt ccttgtgaa   2820
acaggtatgt tgaaggcaac atatgaacta ccacaaggaa ccttgtacga gatttttttca   2880
aatggcacat gcttcggaaa aatcattgcg ccagggaatg ctatgcctag agaacaaaag    2940
ctcaccatcg aaactgaaac tgattccgta ttatgggtta tagactctag ctcgttgaac    3000
aaattgaaag aagacaatct agcattgtac gtggaggttg cattaatggt catgtgtatc    3060
aaggacacca gattcaaaga attactaggt tacacacttg ttagcgcatg a             3111

SEQ ID NO: 104
MGRTIRRRRS NSSLSEAISV SLGINQDSSV NKMHRASVSA MSPPLCRSYM SGFFTGGNSP     60
MINNLSDSKL PISNKQHPKV IHGSENLHRQ TAQLSNEFCS SSVEENSPTI KDYMDIIGNG    120
```

TABLE 3-continued

Sequences disclosed herein.

```
DRKDDQSMRT IEENIDEEYS DEYSRLLLSP ASSNVDDDRN RGLQNSSLPE LEDGYAGGYQ    180
SLRPSHNLRF RPRNLWHMCT SFPSKFAHYL PAAVLGLLLN ILDALSYGMI IFPITEPVFS    240
HLGPTGISMF YISTIISQAV YSGGWSSFPS GIGSEMIEIT PFYHTMALAI KEALAGNDDE    300
IITTTIFCYV ISSMLTGVVF YALGKLRLGK IVGFFPRHIL IGCIGGVGYF LIITGIEVTT    360
RVAKFEYSWP FFSGLFTDYD TLAKWLLPVL LTVVLIGTQR YFKNSLVLPS FYILTLVLFH    420
FIVAIIPTLS LDALRQAGWI FPIANSDSKW YDHYRLFNVH KVHWSLVLQQ IPTMMALTFF    480
GILHVPINVP ALAMSLQMDK YDVDRELIAH GYSNFFSGLL GSVQNYLVYT NSVLFIRAGA    540
DSPFAGFLLI ALTICIMIIG PVIISFIPIC IVGSLIFLLG YELLVEALVD TWNKLNRFEY    600
LTVVIIVFTM GIFDFVLGII VGILIACFSF LVDSTKLQTI NGEYNGNVAR STVYRDYVQT    660
KFLDGIGEQI YVLKLQNLLF FGTIISIEEK IERLLQISNK DATKRRIKYL ILDFKNINAD    720
NIDYSAAEGF NRIKRFTETK RIKLIISSIK ERDRIYNAFN NVGLLNDVEL FADLNSALEW    780
CENEFLFQYK QLRKKAKERL EEGKQNNVVS AVIAATKNKK IDTIGNGLNR GSNGDTARNL    840
MSLPTNTPRN YQILSVAQNV FVNDEQAVKN FKKEYKDDEP VLPILLFALK QYRPDIISEV    900
QKVREKEIKF WAQLCPYFTR RRLASQSHLL HADNIFFLVE TGMLKATYEL PQGTLYEIFS    960
NGTCFGKIIA PGNAMPREQK LTIETETDSV LWVIDSSSLN KLKEDNLALY VEVALMVMCI   1020
KDTRFKELLG YTLVSA                                                  1036

SEQ ID NO: 105
atgggtctat catctatctt tggcggcggt gcaccatcac aacaaaagga agcagccact     60
actgcaaaga caaccccaaa ccctatagcc aaggagctga aaaaccaaat tgctcaagaa    120
ctggctgtgg ctaatgcgac tgaattagtg aacaaaattt ctgagaactg ctttgaaaaa    180
tgcttaactt cgccatacgc taccagaaac gatgcgtgca ttgaccagtg tttggctaaa    240
tatatgagaa gttggaatgt catatcaaag gcttacatct ccagaatcca gaacgcctcc    300
gcttctggcg aaatctaa                                                 318

SEQ ID NO: 106
MGLSSIFGGG APSQQKEAAT TAKTTPNPIA KELKNQIAQE LAVANATELV NKISENCFEK     60
CLTSPYATRN DACIDQCLAK YMRSWNVISK AYISRIQNAS ASGEI                   105

SEQ ID NO: 107
atggaggcta catcaagtgc tctttcgtct acggcgaatc tcgttaagac aatagttggc     60
gctggtacac ttgccattcc gtacagtttt aaaagcgatg gtgttctggt aggggttatt    120
cttacattat tggcggcggt aacatccggt ctgggtctct ttgtgctatc gaaatgttcc    180
aagaccttaa ttaatccaag aaactcttct ttcttcacat tatgcatgct cacctatccc    240
actttggccc caatttttga tttggcaatg atagttcaat gctttggtgt gggcttaagt    300
tacttagttc ttattggtga tctctttcca ggactgtttg gtggtgaaag aaattattgg    360
ataattgcat cagctgtaat catcattccc ctatgtttag tgaagaaact agatcaattg    420
aagtattcta gtattctagg tctttttcgcg ctagcataca tatcaattct ggtgttcagt    480
cattttgtgt ttgagctggg aaagggtgaa ttaacaaata tattaagaaa tgacatatgc    540
tggtgaaaaa ttcacgactt taaggatta ttatcaactt ttagcattat aattttttgct    600
tttacgggat caatgaacct attccccatg ataaatgaat taaaagacaa cagcatggaa    660
aatatcactt cgttatcaa taattcgata tcctatcaa cagcactatt tttgatcgtt    720
ggtttatcag gatatttaac cttcggtaat gaaaccttgg gtaatttaat gttgaactac    780
gatcctaact caatttggat agtaattggc aaattcttgc ttggctcaat gttaattctt    840
tccttcccgc ttctctttca tccgctgcgc atagcagtta acaatgtcat catctgatt     900
gagatcactt atggtggggc aaatcccgaa gaggacccac aagtttcgga atacactcgt    960
gcttccaacc taagaccaat tagcatgact gtggaagatc cagcccagcc cagtgatgca   1020
ctagacgcaa cttccttataa cgagcaagaa tgtttactac ctaacgggaa ctttgataat   1080
ggttcaattg aaagtcaaga gaacaataat gatgaaagag ggactggc ggtcgccggg     1140
gataacgagc atcatgcgcc atttgttaag tctagatttt actggattac tgcattatta   1200
ctaataagca tgtataccct ggcgttgtct gtccagtcat ttgcactggt tctttcattt   1260
gtaggggcta caggttcaac gtctatttca ttcactttac ctggattatt aggttacaaa   1320
ttaataggct tggattcttt ggcttattggg aagatgattc caccaaaaga tagattttac   1380
aaaaggtgca gcttattgct agtcttctac ggactatctg tgatgttttt gtcattgtat   1440
gtaactgtat tcaaccgttc agatgaagcc taa                                1473

SEQ ID NO: 108
MEATSSALSS TANLVKTIVG AGTLAIPYSF KSDGVLVGVI LTLLAAVTSG LGLFVLSKCS     60
KTLINPRNSS FFTLCMLTYP TLAPIFDLAM IVQCFGVGLS YLVLIGDLFP GLFGGERNYW    120
IIASAVIIIP LCLVKKLDQL KYSSILGLFA LAYISILVFS HFVFELGKGE LTNILRNDIC    180
WWKIHDFKGL LSTFSIIIFA FTGSMNLFPM INELKDNSME NITFVINNSI SLSTALFLIV    240
GLSGYLTFGN ETLGNLMLNY DPNSIWIVIG KFCLGSMLIL SFPLLFHPLR IAVNNVIIWI    300
EITYGGANPE EDPQVSEYTR ASNLRPISMT VEDPAQPSDA LDATSYNEQE CLLPNGNFDN    360
GSIESQENNN DERGTMAVAG DNEHHAPFVK SRFYWITALL LISMYTLALS VQSFAVLVLSF   420
VGATGSTSIS FTLPGLLGYK LIGLDSLAIG KMIPPKDRFY KRCSLLLVFY GLSVMFLSLY    480
VTVFNRSDEA                                                          490

SEQ ID NO: 109
atggcaccgg aaatttttgt taaattcaag tgtgcaagta gagacataaa gctactatgg     60
gcgtccgtct ttcttagact tctatcatat ggtttaacaa atcaagtttt gacgctttt    120
ttaaatgcca tcaatatgac agaggataaa attgggctgt tatgtcatt aacactggca    180
ggggatgtaa tttgctctta cattcttact ggtatgcgg attcctgggg ccgaagaaga    240
gtcctagttt atggttgtgc aatgatgttg ttaagtgggt tggttttcag tttagcgaa    300
aatttcaccc tcttgctagt atttgctatc ttcggtgtta tatcgccttc aagtgatgaa    360
gtcgggcctt tcaaatctat agaagaggcc atgattgcac atctgagtcc tcataatgca    420
agaccagaga tttatgctat tcacgccttg gttggaacaa ttggaagcgc tctaggtgca    480
ataatttgtg gtatatttgt agatcttttg aaaagaactg gttagctgc tactgatttg    540
caatgttata aattagtttt cttactgtat gccttcttcg cctttttgcaa aatggtcatc    600
```

TABLE 3-continued

Sequences disclosed herein.

```
atgctcttat tatcagatgc tacagaattg gacgggcatt atgaacatac agattgcaat    660
gaagaaacag ctgaaccatt ggacgttaac gatgaaactg caccattaat gagacaagca    720
actcacccag aagaaagatc caacaaacta tctaaggaga ccgtttcggt tttgatgaaa    780
ttgttagtaa tcttcatggt cgactctctc gggtccgggt ttatgacaag tggctggatg    840
gtttactact atagtaagca attttttgatg ggatctctgg cgttgggtac tttattttc     900
atcacgcaac tggttatggc atcttccacc atcccatcat caataattgc cagatgtttt    960
ggcccagtaa gagccacact attggtccaa attccatcag ggatattttc tattctcatc   1020
cctatggcca agaattactt gcccttatct attttgtttt tgaatctgca ttttgcaaca   1080
actgccatgg acgttacacc aaggcaaatt ctattaacaa atatcatcaa accaagagat   1140
ttaaccaaag ttatgggggt ggtcaacatt ggaaagacat ttgctcggtg tgttggtcca   1200
atattcacgg gtatacttgc taacaataat tatttatggc tatgttacat cattagtggg   1260
tccttggtga taacggcgga tctaaatactg gcatgcatgt ttttaggagt ggacgctaaa   1320
attaaaaagc aaatgaaccg ccattaa                                       1347

SEQ ID NO: 110
MAPEIFVKFK CASRDIKLLW ASVFLRLLSY GLTNQVLTLF LNAINMTEDK IGLFMSLTLA     60
GDVICSYILT WYADSWGRRR VLVYGCAMML LSGLVFSFSE NFTLLLVFAI FGVISPSSDE    120
VGPFKSIEEA MIAHLSPHNA RPEIYAIHAL VGTIGSALGA IICGIFVDLL KRTGLAATDL    180
QCYKLVFLLY AFFAFCKMVI MLLLSDATEL DGHYEHTDCN EETAEPLDVN DETAPLMRQA    240
THPEERSNKL SKETVSVLMK LLVIPMVDSL GSGFMTSGWM VYYYSKQFLM GSLALGTLFF    300
ITQLVMASST IPSSIIARCF GPVRATLLVQ IPSGIFSILI PMAKNYLPLS ILFLNLHFAT    360
TAMDVTPRQI LLTNIIKPRD LTKVMGVVNI GKTFARCVGP IFTGILANNN YLWLCYIISG    420
SLVITADLIL ACMFLGVDAK IKKQMNRH                                       448

SEQ ID NO: 111
atgacatcta tagataatag acctttgccg ttcatatacc agttcacagc cggtgccatt     60
gccggcgtct cggagctatt ggtgatgtat ccattggacg tggtgaagac aagaatgcaa    120
ttacaagtga caaccaaagg tcatcccgct gttgttgcaa cgaaagcagc agtagatcac    180
tacacgggcg tgatggattg tcttacaaaa attgtgaaga aggaaggatt tcgcatcctt    240
tacaagggta tcacatcgcc tatattaatg gaggctccga aaagagcaat taagttctcc    300
ggaaacgata cattccaaac gttttataaa aagattttcc ccacgcccaa tggggagatg    360
actcaaaaaa tcgccatata cagtggtgcg tccgctggcg ccgtgaaagc ctttgtcgtc    420
gcgccttttg aactagtgaa gattagatta caggatgtga attcacagtt caagacaccc    480
attgaagttg taaagaatag tgttgtgaaa ggtggtgttt tgtcacttt caatgggttg     540
gaagccacta tctggagaca cgttcttttgg aatgccggtt atttcggtat aatattccaa    600
attcggaagc ttttgccggc ggctaaaaca agcacggaaa agaccagaaa tgatttgatc    660
gcaggtgcta ttggtggcac tgtcgggtgc ttgttaata caccatttga cgtggtaaaa    720
tctaggatcc aaaagaagttc cgggccgctg aggaagtaca actggtccct gccttcagtg    780
ctgttagttt accgtgagga agggtttaaa gcattgataa agggatttgc gccaaaggtc    840
atgagacttg ccccccggtgg tgggttattg ttggtagttt tcacgaacgt catggatttt    900
ttcagagaag tcaagtatgg taaaaaacaa tga                                 933

SEQ ID NO: 112
MTSIDNRPLP FIYQFTAGAI AGVSELLVMY PLDVVKTRMQ LQVTTKGHPA VVAAKAAVDH     60
YTGVMDCLTK IVKKEGFSHL YKGITSPILM EAPKRAIKFS GNDTFQTFYK KIFPTPNGEM    120
TQKIAIYSGA SAGAVEAFVV APFELVKIRL QDVSQFKTP IEVVKNSVVK GGVLSLFNGL     180
EATIWRHVLW NAGYFGIIFQ IRKLLPAAKT STEKTRNDLI AGAIGGTVGC LLNTPFDVVK    240
SRIQRSSGPL RKYNWSLPSV LLVYREEGFK ALYKGFAPKV MRLAPGGGLL LVVFTNVMDF    300
FREVKYGKKQ                                                           310

SEQ ID NO: 113
atgtcttcga acgattcgaa cgataccgac aagcaacata cacgtctgga tcctaccggt     60
gtggacgacg cctacatccc tccggagcag ccggaaacaa agcaccatcg ctttaaaatc    120
tctagggaca ccctgagaga ccactttatc gctgcggtcg gtgagttctg cggcacattc    180
atgttttttat ggtgcgctta cgttatctgc aatgtcgcta accatgatgt cgcactcgtt    240
gcagcgcctg acgttcccca tccgggtcaa ttgattatga ttgccatcgg tttcggattt    300
tccgtcatgt tttctatctg gtgttttgcc ggtgtctctg gtgggggttt gaatcctgct    360
atgtcgcttt cgctgtgctt ggcgagagcc gtctctccta caagatgtgt cgttatgtgg    420
gtttcgcaga ttgttgctgg aatggccgct ggaggcgctg caagcgccat gacacctggt    480
gaagtcctct ttgccaattc ttttgggcctg ggctgctcta ggacgagggg tctgttcctg    540
gagatgttcg gcaccgctat cctatgttta acagtcttaa tgacggctgt gagaagcgt     600
gaaaccaact ttatggctgc gctgcccatc ggcatctccc tgtttatcgc acacgtcgct    660
ttgactgcat acacaggcac aggtgtcaac cctgcgaggt ccttgggtgc tgctgtcgca    720
gccagatact tccctcatta ccactggatt tattggattg gcacgctgtt aggatccatt    780
ttagcatggt ctgtatggca attattgcaa atcttagact acacaaccta cgttaccgct    840
gaaaaggctg ccagcaccaa ggaaaaagct caaaaaaaag gtgaaaccag cagttcctct    900
gctgtggctg aagtctaa                                                 918

SEQ ID NO: 114
MSSNDSNDTD KQHTRLDPTG VDDAYIPPEQ PETKHHRFKI SRDTLRDHFI AAVGEFCGTF     60
MFLWCAYVIC NVANHDVALV AAPDGSHPGQ LIMIAIGFGF SVMFSIWCFA GVSGGALNPA    120
MSLSLCLARA VSPTRCVVMW VSQIVAGMAA GGAASAMTPG EVLFANSLGL GCSRTRGLFL    180
EMFGTAILCL TVLMTAVEKR ETNFMAALPI GISLFIAHVA LTAYTGTGVN PARSLGAAVA    240
ARYFPHYHWI YWIGTLLGSI LAWSWQLLQ ILDYTTYVTA EKAASTKEKA QKKGETSSSS    300
AVAEV                                                                305
```

TABLE 3-continued

Sequences disclosed herein.

SEQ ID NO: 115
```
atgagtgaaa cagtcaaaga taaagttata attgatgaga aggtatccac aaaaggtact    60
gttgattacg ccgagggtgc tgagtattct gagaggcttt caaatcattc atcagacttt   120
tctcagtggt atacggatga acagatactg cactttatga agaagctggg ttatgaaaat   180
cgcactcttt atgatattcc ggaagacgtt gcgtatatcc tcaaaaaaat gcctgaattg   240
acacttgagg attccttcaa aatactaaaa gactctatca tctatttcaa ggatgatgaa   300
aacattccac acgatcaata tgaggagtgg aagagattgg ttgacttgga ggacttggat   360
tcaaaagagg ggatagatga atatgatagc tttgacatta gagcatttgc ttctgctatt   420
aaatttcatt cgccttacca agaggttaga gctgttgttg atccagaaga tgatcccacc   480
attccagtgg agacattccg agcatatttt ctggcaataa tttggtctgt catcggttca   540
ggatttaatg agtttttttc acacagggtg gtttcaattt cactgaatac tccaattatc   600
caaatgtttt tatatatctg tggtaaggct tgggctaaaa ctatcccctg ttggactata   660
accatcaggg gcagaaagta tggtatcaat atcgataaac catggaccca aaaagagcaa   720
atgttttcaa ccttgttata tgcaatttgt caaggcgcgt tctatactca ttacaatatt   780
ctaacgcaaa aactctttta ccattctgct ttctcgtttg gctaccaatt tttactttcg   840
ttatccgtac aatttattgg atttggattt gctggcatcc ttagaaaatt cgttgtttat   900
ccagcccgtg cactatggcc aacagtcatg ccaactattg ctatcaacaa ggcactattg   960
ggtaaagaaa agcatgaatc tggaatgagc aggtataaat tctttttctt gactttttt   1020
atcatgttca tctataactg gtttcccact tacattatta atattctaaa cactttcaat  1080
tggatgacct ggatcaagcc aagtaacatt aatctcgcaa acatcacggg aggagtcact  1140
ggtcttggga ttaatcctat ctcatctttt gactggaatg ttatttcgtt taattctcct  1200
ttagtttacc cattttggtc atacttaaca caatatcttg gttgcatatt agcagcttta  1260
attgttattg cagtatacta tagtaattat atgagttgcc aatacctgcc aatattcaca  1320
aattctttgt atactaatac tggccattcc tttaaagtta ctgaggtatt agacagtgac  1380
aataagctag atgtgaaaaa atatcaaagc tactcgccac catactatag tgctggaaat  1440
ttggtatcat atggtgcttt catttgcgca tatcctctga tgattacatg gtcgtttatt  1500
gtacactcaa agttattgtt caatgctttc aaagattggg ctttgaattt gtgggccatg  1560
agaaaactta aatcttgggt cacaatgttc aaaagcgatt acagggcgct cgacgattat  1620
gatgacccac attctaatgc catgaaaaac tataaagaag ttccagattg gtggtatttt  1680
gccatattga taggttcact tgttgttgga atagctgttg tagagcacta cccaacaaat  1740
acaccagttt ggggtctttt tgtttgttta ggatttaatt ttgtttttctt gattccaact  1800
actatccttc aagcaaccac tggttattcg tttggtttga atctactaat tgaaatggtg  1860
atggggtacg cttaccagg taatccaatc gccataatga ttttgaaggc ttttggttat  1920
aacatcgacg gccaagcaga taattacgtt tctaacttaa aaatagcgca ttattgtaag  1980
attccgccaa tggcgctatt caggggacaa tgtgttatag ttttcattca gatatttgtc  2040
aatctaggtg ttctgaattg gcaaatctcc aatatcaaag actttgtcac acctcatcaa  2100
aacgcaaaat tcacctgtcc tgatgctgtg acctactata atgcttccgt tgtctggggt  2160
gcaattgggc caaaagaat tttcaattac atttatccaa tatttaaatg gtgttggttg  2220
ataggcgcat gcattggcat attttttggt gtttggaagc gctggggtaa gttttatccc  2280
agatatttg acccaatgtt atttgtaggt ggaatgctta atatgagccc tccatataac  2340
ctgatgtatt acacttctgg tatgattgtt agttacattt cccagtacta catgaaaaga  2400
caccatttaa atctgtggga gaaatataat tatgttttat cggcaggctt ttcaacgggc  2460
ttggttttat cagctattat cattttcttt gctgtcaatt ataaagacac agcttttaat  2520
tggtggggca atacagttcc gtatgctggt gccgatggcg ttggctatcc tctaaagaac  2580
ataactgata cagcaaatgg ctatttcggc tatgctccag gacactatcc atga         2634
```

SEQ ID NO: 116
```
MSETVKDKVI IDEKVSTKGT VDYAEGAEYS ERLSNHSSDF SQWYTDEQIL HFMKKLGYEN    60
RTLYDIPEDV AYILKKMPEL TLEDSFKILK DSIIYFKDDE NIPHDQYEEW KRLVDLEDLD   120
SKEGIDEYDS FDIRAFASAI KFHSPYQEVR AVVDPEDDPT IPVETFRAYF LAIIWSVIGS   180
GFNEFFSHRV VSISLNTPII QMFLYICGKA WAKTIPCWTI TIRGRKYGIN IDKPWTQKEQ   240
MFSTLLYAIC QGAFYTHYNI LTQKLFYHSA FSFGYQFLLS LSVQFIGFGF AGILRKFVVY   300
PARALWPTVM PTIAINKALL GKEKHESGMS RYKFFFLTFF IMFIYNWFPT YIINILNTFN   360
WMTWIKPSNI NLANITGGVT GLGINPISSF DWNVISFNSP LVYPFWSYLT QYLGCILAAL   420
IVIAVYYSNY MSCQYLPIFT NSLYTNTGHS FKVTEVLDSD NKLDVKKYQS YSPPYYSAGN   480
LVSYGAFICA YPLMITWSFI VHSKLLFNAP KDWALNLWAM RLKSWVTMF KSDYRALDDY   540
DDPHSNAMKN YKEVPDWWYF AILIGSLVVG IAVVEHYPTN TPVWGLFVCL GFNFVFLIPT   600
TILQATTGYS FGLNLLIEMV MGYALPGNPI AIMILKAFGY NIDGQADNYV SNLKIAHYCK   660
IPPMALFRGQ CVIVFIQIFV NLGVLNWQIS NIKDFCTPHQ NAKFTCPDAV TYYNASVVWG   720
AIGPKRIFNY IYPIFKWCWL IGACIGIFFG VWKRWGKFYP RYFDPMLFVG GMLNMSPPYN   780
LMYYTSGMIV SYISQYYMKR HHLNLWEKYN YVLSAGFSTG LVLSAIIIFF AVQYKDTAFN   840
WWGNTVPYAG ADGVGYPLKN ITDTANGYFG YAPGHYP                             877
```

SEQ ID NO: 117
```
atgaagagta ctttgagttt aactttatgt gttatatcgc ttctattaac cctttttctg    60
gcggccttgg atattgttat agtggttact ttatatgata caattggcat taagttccat   120
gacttcggca atattggttg ttagttact ggatatgctc tttctaatgc tgttttcatg   180
ttattatggg gtcgcttggc cgaaatactt ggtacaaagg agtgcttaat gatttctgtt   240
attgtatttg aaatagggtc tttgattcct gctctttcga attcaatggc gactctgatt   300
agcggaaagag tcgttgctgg gtttggagga agtggaattg aatcacttgc ttttgtagtt   360
ggaacatcca ttgtccgaga aaaccataga ggaattatga taacggcact cgctatatcg   420
tatgtcattg cagagggagt cgggcctttt attggtggtg cattaataga acatttgtct   480
tggagatggt gcttttatat aaatcttcca atcggtgcgt ttgcgttcat aatattggca   540
ttttgtaaca catctggaga accacatcaa aaaatgtggc taccatcaaa aatcaaaaaa   600
attatgaact atgactatgg cgaattattg aaagcaagtt tttggaagaa tacatttgaa   660
gtacttgtat ttaaactaga catggttggg attatttat cttcagcagg ctttacacta   720
ctgatgttag gtctttcatt tggtggaaac aacttcccat ggaattcggg tatcattatt   780
```

TABLE 3-continued

Sequences disclosed herein.

```
tgcttttta   ccgtgggccc   tatcttattg   ttactatttt   gtgcttacga   ctttcatttt    840
ctgtcattat  cggggcttca   ctatgacaac   aagcggatca   aaccgttact   gacatggaat    900
attgcctcaa  attgtggcat   atttacaagc   tccataacag   gattcctttc   ttgctttgct    960
tatgaattac  agtctgctta   tttagtccag   ctttatcaac   tagtatttaa   aaaaaagcct   1020
acattagcga  gtatacatct   ttgggaacta   tcaattccag   ctatgattgc   aactatggcc   1080
atagcatatc  taaattcaaa   atatggcatc   atcaaaccgg   caattgtttt   tggtgtgctt   1140
tgtgggattg  ttggatctgg   tttatttacg   ctaatcaatg   gcgaactctc   tcagtcaata   1200
ggttattcaa  ttctcccagg   aatagctttt   ggtagtattt   tccaagcaac   gttattaagc   1260
tcccaggtgc  agataacatc   agacgatcca   gactttcaaa   acaagtttat   tgaagtcaca   1320
gctttcaact  cgttcgccaa   atccttgggc   tttgcgtttg   gagggaatat   ggggcaatg    1380
atattcactg  catcactcaa   aaaccagatg   cgctcttccc   aattaaacat   accacaattt   1440
acgtctgtag  aaacactttt   agcgtatagc   acagaacatt   atgatggccc   caatccttca   1500
ctatcaaagt  tcataaacac   agctatccat   gacgttttt    actgcgcctt   aggatgctat   1560
gctctttcat  tcttctttgg   aatattcact   tcgagtaaga   aaacaacaat   atcagccaaa   1620
aagcaacaat  ga                                                               1632

SEQ ID NO: 118
MKSTLSLTLC  VISLLLTLFL   AALDIVIVVT   LYDTIGIKFH   DFGNIGWLVT   GYALSNAVFM     60
LLWGRLAEIL  GTKECLMISV   IVFEIGSLIS   ALSNSMATLI   SGRVVAGFGG   SGIESLAFVV    120
GTSIVRENHR  GIMITALAIS   YVIAEGVGPF   IGGAFNEHLS   WRWCFYINLP   IGAFAFIILA    180
FCNTSGEPHQ  KMWLPSKIKK   IMNYDYGELL   KASFWKNTFE   VLVFKLDMVG   IILSSAGFTL    240
LMLGLSFGGN  NFPWNSGIII   CFFTVGPILL   LLFCAYDFHF   LSLSGLHYDN   KRIKPLLTWN    300
IASNCGIFTS  SITGFLSCFA   YELQSAYLVQ   LYQLVFKKKP   TLASIHLWEL   SIPAMIATMA    360
IAYLNSKYGI  IKPAIVFGVL   CGIVGSGLFT   LINGELSQSI   GYSILPGIAF   GSIFQATLLS    420
SQVQITSDDP  DFQNKPIEVT   AFNSFAKSLG   FAFGGNMGAM   IFTASLKNQM   RSSQLNIPQF    480
TSVETLLAYS  TEHYDGPQSS   LSKFINTAIH   DVFYCALGCY   ALSFFFGIFT   SSKKTTISAK    540
KQQ                                                                           543

SEQ ID NO: 119
atgtcagaag  atcaaaaaag   tgaaaattcg   gtaccttcta   aggttaatat   ggtgaatcgc     60
accgatatac  tgactacgat   caagtcattg   tcatggcttg   acttgatgtt   gccatttact    120
ataattctct  ccataatcat   tgcagtaata   atttctgtct   atgtgccttc   ttcccgtcac    180
acttttgacg  ctgaaggtca   tcccaatcta   atgggagtgt   ccattccttt   gactgttggt    240
atgattgtaa  tgatgattcc   cccgatctgc   aaagtttcct   gggagtctat   tcacaagtac    300
ttctacagga  gctatataag   gaagcaacta   gccctctcgt   tattttgaa    ttgggtcatc    360
ggtcctttgt  tgatgacagc   attggcgtgg   atggcgctat   tcgattataa   ggaataccgt    420
caaggcatta  ttatgatcgg   agtagctaga   tgcattgcca   tggtgctaat   ttggaatcag    480
attgctggag  agacaatgga   tctctgcgtc   gtgcttgtta   ttacaaactc   gcttttacag    540
atggtattat  atgcaccatt   gcagatattt   tactgttatg   ttatttctca   tgaccacctg    600
aatacttcaa  ataggtatt    attcgaagag   gttgcaaagt   ctgtcggagt   ttttctcggc    660
ataccactgg  gaattggcat   tatcatacgt   ttgggaagtc   ttaccatagc   tggtaaaagt    720
aattatgaaa  atacatttt    gagatttatt   tctccatggg   caatgatcgg   atttcattac    780
actttatttg  ttattttttat  tagtagaggt   tatcaattta   tccacgaaat   tggttctgca    840
atattgtgct  ttgtcccatt   ggtgctttac   ttctttattg   catggttttt   gacctttgca    900
ttaatgaggt  acttatcaat   atctaggagt   gatacacaaa   gagaatgtag   ctgtgaccaa    960
gaactacttt  taaagagggt   ctggggaaga   aagtcttgtg   aagctagctt   ttctattacg   1020
atgacgcaat  gtttcactat   ggcttcaaat   aattttgaac   tatccctggc   aattgctatt   1080
tccttatatg  gtaacaatag   caagcaagca   atagctgcaa   catttgggcc   gttgctagaa   1140
gttccaattt  tattgattt    ggcaatagtc   gcgaggatcc   ttaaaccata   ttatatatgg   1200
aacaatagaa  attaa                                                            1215

SEQ ID NO: 120
MSEDQKSENS  VPSKVNMVNR   TDILTTIKSL   SWLDLMLPFT   IILSIIIAVI   ISVYVPSSRH     60
TFDAEGHPNL  MGVSIPLTVG   MIVMMIPPIC   KVSWESIHKY   FYRSYIRKQL   ALSLFLNWVI    120
GPLLMTALAW  MALFDYKEYR   QGIIMIGVAR   CIAMVLIWNQ   IAGGDNDLCV   VLVITNSLLQ    180
MVLYAPLQIF  YCYVISHDHL   NTSNRVLFEE   VAKSVGVFKL   IPLGIGIIIR   LGSLTIAGKS    240
NYEKYILRFI  SPWAMIGFHY   TLFVIFISRG   YQFIHEIGSA   ILCFVPLVLY   FFIAWFLTFA    300
LMRYLSISRS  DTQRECSCDQ   ELLLKRVWGR   KSCEASFSIT   MTQCFTMASN   NFELSLAIAI    360
SLYGNNSKQA  IAATFGPLLE   VPILLILAIV   ARILKPYYIW   NNRN                      404

SEQ ID NO: 121
atgtattcaa  ttgttaaaga   gattattgta   gatccttaca   aaagactaaa   atggggtttt     60
attccagtaa  agcggcaggt   ggaagacctg   ccagatgact   aaattcaac    agaaattgtc    120
actatctcca  acagtatcca   gagtcatgaa   acagctgaaa   atttcatcac   gactacaagt    180
gaaaaagatc  aactacattt   tgagactagt   agctatagtg   aacataaaga   caatgtgaac    240
gttactagaa  gttatgaata   tagagatgaa   gccgataggc   catggtggag   attttttcgat   300
gaacaagagt  atcggatcaa   tgaaaaggaa   agatctcaca   taaatggta    tagttggttc    360
aaacagggta  cctcttttcaa  agaaaaaaaa   ttattaatta   aattggatgt   ccttttagcc    420
ttttattctt  gtattgctta   ttgggtgaaa   tatctgatta   cggttaatat   aaacaacgct    480
tacgtttcgg  gaatgaagga   agatttaggc   tttcaaggta   atgatttggt   gcatactcaa    540
gtaatgtaca  cagttggtaa   tattatattt   caattgccat   ttttgattta   cctgaacaag    600
ctcccattaa  actatgtttt   accaagcctc   gactatgtt    ggtcgctttt   aaccgttggt    660
gctgcatatg  tcaattctgt   accacacttg   aaagcaatta   ggtttttcat   tggggcttt    720
gaagcgccaa  gttatttggc   ataccaatat   ttgtttggtt   ccttttacaa   acatgatgaa    780
atggtgcgtc  gttctgcttt   ttactatttg   ggcagtata    tcggtattct   atcgctggt    840
gggatccagt  cagccgtata   ttcatcgtta   aatggtgtaa   atggtttaga   gggatggaga    900
tggaacttta  ttattgacgc   tattgtgtct   gtcgtagtgg   gccttattgg   attttactcc    960
ctgccaggtg  acccatacaa   ctgttattct   attttcttaa   ctgatgatga   aattaggttg   1020
```

TABLE 3-continued

Sequences disclosed herein.

```
gcgaggaaaa gattaaaaga aaaccaaaca ggtaaaagtg attttgaaac aaaagtattc   1080
gatattaaac tgtggaaaac aattttcagt gattggaaaa tatacatttt aacttttatgg  1140
aatattttct gttggaatga cagtaatgtt tcatctgggg catacctact atggttgaaa   1200
tctttgaaaa gatactctat tcctaagctc aatcagttat ccatgattac tccgggttta   1260
ggtatggttt atttgatgct tactggtatt attgcagata aattacactc tcgttggttt   1320
gcgattattt ttactcaggt tttcaatatc attggtaact ccatattagc cgcttgggac   1380
gtcgcagaag gagccaaatg gtttgcattt atgctgcaat gttttggttg ggctatggct   1440
cctgttttat actcttggca aaacgatatt tgtcgccgag atgctcaaac tagagctatt   1500
actttagtta caatgaatat tatggctcaa tcatctaccg catggataag tgttttggtt   1560
tggaaaacag aagaagctcc caggtattta aaggggttta ctttcactgc atgttctgct   1620
ttttgtctct ccatttggac ttttgttgta tctctacttct ataaacgtga tgaaaggaac  1680
aatgccaaga agaacggtat tgtgctttat aactctaaac atggtgtgga aaagccaacg  1740
tcaaaagacg ttgaaacctt atcagtatct gatgaaaaat aa                     1782

SEQ ID NO: 122
MYSIVKEIIV DPYKRLKWGF IPVKRQVEDL PDDLNSTEIV TISNSIQSHE TAENFITTTS   60
EKDQLHFETS SYSEHKDNVN VTRSYEYRDE ADRPWWRFFD EQEYRINEKE RSHNKWYSWF  120
KQGTSFKEKK LLIKLDVLLA FYSCIAYWVK YLDTVNINNA YVSGMKEDLG FQGNDLVHTQ  180
VMYTVGNIIF QLPFLIYLNK LPLNYVLPSL DLCWSLLTVG AAYVNSVPHL KAIRFFIGAF  240
EAPSYLAYQY LFGSFYKHDE MVRRSAFYYL GQYIGILSAG GIQSAVYSSL NGVNGLEGWR  300
WNFIIDAIVS VVVGLIGFYS LPGDPYNCYS IFLTDDEIRL ARKRLKENQT GKSDFETKVF  360
DIKLWKTIFS DWKIYILTLW NIFCWNDSNV SSGAYLLWLK SLKRYSIPKL NQLSMITPGL  420
GMVYLMLTGI IADKLHSRWF AIIFTQVFNI IGNSILAAWD VAEGAKWPAF MLQCFGWAMA  480
PVLYSWQNDI CRRDAQTRAI TLVTMNIMAQ SSTAWISVLV WKTEEAPRYL KGFTFTACSA  540
FCLSIWTFVV LYFYKRDERN NAKKNGIVLY NSKHGVEKPT SKDVETLSVS DEK         593

SEQ ID NO: 123
atgccgtcaa acgtacgttc gggagtctta actttgctcc atacagcatg tggagcaggc   60
gtacttgcaa tgccgtttgc attcaagcca tttgggttaa tgcctggtct gataacgcta  120
acattttgcg gaatatgttc cttatgtggg ctgctattac agactcgaat agcgaagtac  180
gtacctaaat ctgagaacgc ctcgtttgct aaactcaccc aactaatcaa tccgtcaata  240
agtgtagtgt tcgattttgc cattgctgtt aaatgttttg gcgttggtgt atcttactta  300
attattgttg gtgacttagt gccacagata gtgcagtcaa ttttttatcg taacgatgat  360
aacatgagtg gttcgcaaga gcatcacatg ttccttagaca ggcgtttgta tataactctg  420
atcatagtgt ttgttatctc ccctttatgc tttaaaagaa gtttgaattc tctacgatat  480
gcttctatga ttgccattgt tagtgtcgca tatttatctg gtttgattat ttaccattta  540
gtaaatcggc atcagctaga gagagggcaa gtatatttta tggtacctca cggagattct  600
cagtctcatt ctcccctgac tacattgcca attttttgtgt ttgcttacac ttgtcaccac  660
aatatgttca gtgtaattaa tgagcaagtg gataagagct tcaaggtaat caggaggatt  720
ccgattttttg ccatcgtgtt ggcctatttt ttatacatca taattggtgg tacaggttat  780
atgacatttg gtgagaatat tgtaggaaat atcctcactt tataccccgaa ttccatctcc   840
accaccatcg ggaggttagc aatgctgcta ttagttatgt tagcatttcc attgcaatgc   900
catccttgca gatcatcggt aaaaacata attatattca ttgaaaattt cagaaaaggt   960
aagttatacg ataacagagc tagctttatt ccattagaca actttaatag tgaagatccg  1020
caggaggcgc caacccaaca aaacaacgaa gagccaaatc tgcgtagtga gtctttacgg  1080
catatcaata ttatcaccct ttgtatctta ctgttctcat atctactggc tatttcaatt  1140
acgtctctag caaaagtcct agcaatagtt ggtgccacgg gatctacgtc gatttctttc  1200
attttgccag gccttttttgg ttataaatta attggctcag aatttacggg cacgaatgaa  1260
agagtaccga caagcataaa aatattcaaa tacttaagtt tatctctatt catctggggg  1320
atagcagtaa tggtagcttc actatcagcg attgtatttt tgggcacatc atcacattga  1380

SEQ ID NO: 124
MPSNVRSGVL TLLHTACGAG VLAMPFAFKP FGLMPGLITL TFCGICSLCG LLLQTRIAKY   60
VPKSENASFA KLTQLINPSI SVVFDFAIAV KCFGVGVSYL IIVGDLVPQI VQSIFYRNDD  120
NMSGSQEHHM FLDRRLYITL IIVFVISPLC FKRSLNSLRY ASMIAIVSVA YLSGLIIYHF  180
VNRHQLERGQ VYFMVPHGDS QSHSPLTTLP IFVFAYTCHH NMFSVINEQV DKSFKVIRRI  240
PIFAIVLAYF LYIIIGGTGY MTFGENIVGN ILTLYPNSIS TTIGRLAMLL LVMLAFPLQC  300
HPCRSSVKNI IIFIENFRKG KLYDNRASFI PLDNFNSEDP QEAPTQQNNE EPNLRSESLR  360
HINIITLCIL LFSYLLAISI TSLAKVLAIV GATGSTSISF ILPGLFGYKL IGSEFTGTNE  420
RVPTSIKIFK YLSLSLFIWG IAVMVASLSA IVFLGTSSH                         459

SEQ ID NO: 125
atgatgaagg aatcgaaatc tatcactcaa catgaggttg agagagaatc tgtttcttcc   60
aagcgtgcca ttaaaagag attacttctg tttaaaatag acttgtttgt gctatcattt  120
gtttgcttgc aatactggat taattatgtc gaccgtgtgt ttcaccaa tgcatatata  180
tccggtatga aggaagatct taagatggtc ggaaacgatt tgaccgtgtc taacacagtt  240
ttcatgattg gttacattgt aggtatggtc cccaataatt taatgttatt gtgtgttccg  300
cccaggatat ggctaagttt ttgtacgttt gcttggggtt tattgacctt gggaatgtac  360
aaagttacat cgttcaaaca tatttgcgca attagattcc ttcaagcctt atttgagagt  420
tgcacatttt caggaacaca ttttgttttg ggtcgtggt ataagaaga cgaattgccc  480
attagaagtg ctatttttac aggtagcggt tggtgggat ctatgttcag tggatttatg  540
caaacaagta tctttactca tttgaatggg cggaatggct tggcgggttg agatggttta  600
ttcattattg attttgtat cacattaccc attgcaattt atggtttat tttcttccg  660
ggccttcctg atcaaacaag tgctgttagc aaattttcta tgacgagata cattttaat  720
gaacaagagc tacattatgc taggagaagg ctccccgcta gggacgaaag cacccggtta  780
gactggtcga ctattcctag agtcttaaaa aggtggcact ggtggatgtt ctctcttgtt  840
tgggttctgg gaggtgagaa cttggggttc gcatctaatt ctacatttgc attatggtta  900
caaaaccaaa aatatacgtt ggcgcaaaga aataattatc cttcggggat attgccgta   960
```

TABLE 3-continued

Sequences disclosed herein.

```
           ggtatagttt ctacgctttg ttctgctgta tatatgagta agatcccaag agctaggcat   1020
           tggcatgttt ctgttttcat atcattggta atggttattg ttgcggtact aatacgtgca   1080
           gacccactaa atccaaaagt cgtcttttct gcacagtatc ttggaggcgt agcatacgct   1140
           ggacaagcgg ttttttttttc gtgggcaaac attatttgtc atgcagatct tcaagaacgt   1200
           gctatcgttc ttgcttccat gaatatgttt tcaggggccg ttaacgcatg gtggtctata   1260
           ttattctttg cttcagatat ggtgcccaag tttgagagag gttgctacgc cctcttggct   1320
           acggcaatat caagcggaat tgtctcggtc gtcatacgct cactacagat aaaagagaat   1380
           ttgtctaaga aacaggttcc ttatatagat gctaatgaca tgcccggaga agatgacgat   1440
           gacgacaacc aggataatga aaatgatggc gacgacgaga gtatggaagt tgaacttcat   1500
           aatgaggaaa tggccgaaat ttcaaatcct ttccgatag                           1539

SEQ ID NO: 126
           MMKESKSITQ HEVERESVSS KRAIKKRLLL FKIDLFVLSF VCLQYWINYV DRVGFTNAYI    60
           SGMKEDLKMV GNDLTVSNTV FMIGYIVGMV PNNLMLLCVP PRIWLSFCTF AWGLLTLGMY   120
           KVTSFKHICA IRFFQALFES CTFSGTHFVL GSWYKEDELP IRSAIFTGSG LVGSMFSGFM   180
           QTSIFTHLNG RNGLAGWRWL FIIDFCITLP IAIYGFIFFP GLPDQTSAVS KFSMTRYIFN   240
           EQELHYARRR LPARDESTRL DWSTIPRVLK RWHWWMFSLV WVLGGENLGF ASNSTFALWL   300
           QNQKYTLAQR NNYPSGIFAV GIVSTLCSAV YMSKIPRARH WHVSVFISLV MVIVAVLIRA   360
           DPLNPKVVFS AQYLGGVAYA GQAVFFSWAN IICHADLQER AIVLASMNMF SGAVNAWWSI   420
           LFFASDMVPK FERGCYALLA TAISSGIVSV VIRSLQIKEN LSKKQVPYID ANDMPGEDDD   480
           DDNQDNENDG DDESMEVELH NEEMAEISNP FR                                  512

SEQ ID NO: 127
           atgaatcgtg ttggtataga cgtagatcat atgatagggg tcctgcttct ggccgtagtg    60
           gtggtgtttt gggttggcgc ttcgtgtttg actaatgaat tgctcgagac aaacgcgtac   120
           aataaacctt tcttccttac ttatctaaac atatcatcgt ttgctcttta tttgacgcca   180
           gatctatgga ggataatcca atcaagaagg aagagcttgc aggaacggac agaacgaaca   240
           ttacctattc acacacaaga atctttttca gagttcctac ctttactatc ttcaactcct   300
           tctacttctt caaatttgtc ttcgatagcc gacacgaaag tgaaggatac aatgaggttg   360
           agtctgctat tttgcgtctt gtggttcgtg gcaaatttgg cggctaacgc tgctttgtcg   420
           tataccacag tggcttcgtc aacaattctt tcatcgacat cctcattttt taccttattt   480
           cttgccacta gtctaggaat agaaactttt tcgacaaaaa aactgctggg gttatttgtg   540
           tctttgtttg gaattatctt aattgtgatg caatcctcga agcaacagga ttctgtgagt   600
           gcttcctcct ttttgtagg taacacttta gcactgctgg ggtcattggg ttacagtgtc   660
           tatacaaccc ttttgaaata cgaaatatca tccaaaggtc tcagactaga cattcagatg   720
           tttcttggtt atgttggtat cttcagtttt ctgttgtttt ggccaatttt aataatcctg   780
           gatataacac atatgaaac ttttgaacta ccaagtaact tccacatttc ttttcttgtc   840
           atgttaaatt gtatcattat ctttgttagt gactattttt ggtgtaaagc cctcattttg   900
           acatcaccct tggtggttac cgttgcctta acttttacta tcccgttagc catgttcgct   960
           gattttgtat ggcgagaggc attttttacg ccttggtata tcattggtgt tattttcatt  1020
           tttgtttcat tctttctagt taaccatcgg ggagaatctg ctgttgaaaa ggactgtgct  1080
           gcggttgaaa aaggacctat cttggatgcc taa                                1113

SEQ ID NO: 128
           MNRVGIDVDH MIGVLLLAVV VVFWVGASCL TNELLETNAY NKPFFLTYLN ISSFALYLTP    60
           DLWRIIQSRR KSLQERTERT LPIHTQESFS EFLPLLSSTP STSSNLSSIA DTKVKDTMRL   120
           SLLFCVLWFV ANLAANAALS YTTVASSTIL SSTSSFFTLF LATSLGIETF STKKLLGLFV   180
           SLFGIILIVM QSSKQQDSVS ASSFLVGNTL ALLGSLGYSV YTTLLKYEIS SKGLRLDIQM   240
           FLGYVGIFTF LLFWPILIIL DITHMETFEL PSNFHISFLV MLNCIIIFVS DYFWCKALIL   300
           TSPLVVTVAL TFTIPLAMFA DFVWREAFFT PWYIIGVIFI FVSFFLVNHR GESAVEKDCA   360
           AVEKGPILDA                                                           370

SEQ ID NO: 129
           atggttagtt caagtgtttc cattttgggg actagcgcca aggcatccac ttctctaagt    60
           agaaaggatg aaattaaact aaccccctgaa acaagggaag ctagcttgga cattccatac   120
           aaaccccatta ttgcatactg gacggtgatg ggtctctgtc tgatgattgc ctttggtgga   180
           ttcatttttg gttgggatac aggaaccatt tcagggttta ttaaccaaac agatttcaag   240
           agaaggtttg gtgagttaca aagggacggc agttttcaac tatcagatgt caggacaggg   300
           ctaattgtcg gtatcttcaa catagggttgt gctttaggtg gcctaacgct gggacgcctg   360
           ggcgatattt atgggcgtaa aatcggctta atgtgtgtta tactggtgta tgttgttggt   420
           atcgtgatcc agattgcttc ctctgacaaa tggtatcaat attttattgg tagaattgtt   480
           tctggaatgg tgttggagg tgttgctgtg ctgtcgccaa ctttgatctc agaaattttcc   540
           ccaaagcacc taagaggcac ttgtgtctct ttttaccagc taatgattac ccttggaatt   600
           ttcttgggct actgtaccaa ttatggtaca agaaatatt caaattcaat acagtggcgg   660
           gttcccttgg gttttgtttt tgcgtgggca atctttatgt tgattggaat ggttattggtt   720
           ccggaatcgc ccagatattt agtagaaaaa ggtaagtatg aagaagctag aaggtctttg   780
           gccaaatcaa acaaggtcac agttactgat ccaggcgttg ttttttgagtt tgatactata   840
           gttgcaaata tggaattaga aagggctgtt ggaaatgcca gttggcacga actcttctca   900
           aataaaggag caattctacc aagggtaata tgggaaatta ttatccagtc actgcaaacag   960
           cttactggct gtaattattt tttctactac ggcacgacca ttttcaatgc tgttggaatg  1020
           caagactctt tcgagacttc cattgtcctt ggggctgtta attttgcttc tacatttgtt  1080
           gcactataca ttgtgataa atttgggcgt cgaaaatgtt tattgtgggg gtctgcctcg  1140
           atgttttgtcat attccgcacc gttggcgta ctagattatg gccacaaggg  1200
           aaagaccaac cttccttcgca aagtgctggt aatgttatga tcgttttttac ttgtttcttc  1260
           atttttctctt ttgccattac ttgggctcct atcgcctatg tcattgtggc agaaacttat  1320
           ccattaagag ttaaaaatcg tgccatggcc attgcggttg gtgcgaactg gatgtggggt  1380
           ttcttgattg gattttttcac acccttttatc actagatcca taggattttc ttatggctat  1440
           gttttcatgg gttgctaat ctttttcgtac ttctacgttt tcttctttgt ttgcgaaaca  1500
```

TABLE 3-continued

Sequences disclosed herein.

```
aagggattaa ctctggagga agttaatgaa atgtacgaag aaagaataaa gccatggaag   1560
tccggaggtt ggattcccag ttctagaaga acaccacaac caacaagcag tacaccatta   1620
gttattgttg atagtaaata a                                             1641

SEQ ID NO: 130
MVSSSVSILG TSAKASTSLS RKDEIKLTPE TREASLDIPY KPIIAYWTVM GLCLMIAFGG     60
FIFGWDTGTI SGFINQTDFK RRFGELQRDG SFQLSDVRTG LIVGIFNIGC ALGGLTLGRL    120
GDIYGRKIGL MCVILVYVVG IVIQIASSDK WYQYFIGRIV SGMGVGGVAV LSPTLISEIS    180
PKHLRGTCVS FYQLMITLGI FLGYCTNYGT KKYSNSIQWR VPLGLCFAWA IFMVIGMVMV    240
PESPRYLVEK GKYEEARRSL AKSNKVTVTD PGVVFEFDTI VANMELERAV GNASWHELFS    300
NKGAILPRVI MGIVIQSLQQ LTGCNYFFYY GTTIFNAVGM QDSFETSIVL GAVNFASTFV    360
ALYIVDKFGR RKCLLWGSAS MAICFVIFAT VGVTRLWPQG KDQPSSQSAG NVMIVFTCFF    420
IFSFAITWAP IAYVIVAETY PLRVKNRAMA IAVGANWMWG FLIGFFTPFI TRSIGFSYGY    480
VFMGCLIFSY FYVFFFVCET KGLTLEEVNE MYEERIKPWK SGGWIPSSRR TPQPTSSTPL    540
VIVDSK                                                               546

SEQ ID NO: 131
atgtcgctga tcagcatcct gtctccccta attacttccg agggcttaga ttcaagaatc     60
aaaccttcac caaaaaagga tgcctctact accactaagc catcactatg gaaaactact    120
gagttcaaat tctactacat tgcatttctg gtcgtggttc ccttgatgtt ctatgctggg    180
ttacaagcta gttcgcccga aaatccaaac tatgcaagat acgaacgtct cctatctcaa    240
ggttggttat ttggcagaaa agtagacaat agtgattctc aatataggtt tttcagggac    300
aattttgcgc tattgtcagt tttaatgcta gtccacactt ctataaaacg cattgtactt    360
tattcaacaa atatcactaa attgaggttt gatctgatat ttggtttgat cttttttagtg   420
gccgctcatg gtgtcaattc gataagaatt ttagcccata tgctaatttt atatgccatc    480
gcccatgtac taaagaactt tagaagaata gccaccatca gcatttggat ttatggtatt    540
tctacgcttt ttattaacga caacttcaga gcatatccat ttggtaatat ttgctctttt    600
ttaagcccat tggaccattg gtatagaggt atcattccaa gatgggatgt cttttttcaat   660
tttactcttt tgagagtctt aagttacaac ttggacttct tagagaggtg ggagaattta    720
caaaagaaga aaagtccatc ctatgaatca aagaagcta aatcagccat tttgctcaat     780
gaacgtgcta gattaactgc tgcacacccc atacaggact acagcttaat gaattatatt    840
gcatatgtta cttacacgcc acttttcatt gccggcccta ttataacatt caatgattat    900
gtttaccaat cgaaacatac cttgccatca ataaatttca aattcatttt ttactatgcg    960
gtgagattcg ttattgctct cttatctatg gagttcattt tacactttct ccacgttgtg   1020
gcaatctcaa aaaccaaagc gtgggaaaat gacacacctt tccagatttc catgattggc   1080
ttatttaatt tgaatattat ttggctaaaa ctactagttc cgtggaggct gttaggctg    1140
tgggcttttgc tagacggaat cgatacacct gaaaatatga tcaggtgtgt tgataacaat  1200
tacagttcac tagcattctg gagagcttgg catagaagct acaataagtg ggttgtccgt   1260
tacatatata ttcctctagg tggttcaaaa aatagagttt tgacatcact agcagtcttt   1320
tccttcgtag ctatatgcga tgacatcgaa ctaaagttat tattatgggt ttggctaata   1380
gttttgttcc tcttaccaga aatttttgct acccaaattt tctctcatta taccgacgca   1440
gtctggtaca gacacgtttg cgctgtcggt gctgttttca acatatgggt tatgatgatc   1500
gctaatcttt ttggattctg cttgggctct gacggtacta aaaaattact aagcgatatg   1560
ttctgtaccg tatctggttt caaatttgta aatttggcaa gcgttagttt attcatcgca   1620
gtacaaataa tgtttgaaat cagagaagaa gaaaagaggc acgaattta cctaaaatgc    1680
tga                                                                  1683

SEQ ID NO: 132
MSLISILSPL ITSEGLDSRI KPSPKKDAST TTKPSLWKTT EFKFYYIAFL VVVPLMFYAG     60
LQASSPENPN YARYERLLSQ GWLFGRKVDN SDSQYRFFRD NFALLSVLML VHTSIKRIVL    120
YSTNITKLRF DLIFGLIFLV AAHGVNSIRI LAHMLILYAI AHVLKNFRRI ATISIWIYGI    180
STLFINDNFR AYPFGNICSF LSPLDHWYRG IIPRWDVFFN FTLLRVLSYN LDFLERWENL    240
QKKKSPSYES KEAKSAILLN ERARLTAAHP IQDYSLMNYI AYVTYTPLFI AGPIITFNDY    300
VYQSKHTLPS INFKFIFYYA VRFVIALLSM EFILHFLHVV AISKTKAWEN DTPFQISMIG    360
LFNLNIIWLK LLIPWRLFRL WALLDGIDTP ENMIRCVDNN YSSLAFWRAW HRSYNKWVVR    420
YIYIPLGGSK NRVLTSLAVF SFVAIWHDIE LKLLLWGWLI VLFLLPEIFA TQIFSHYTDA    480
VWYRHVCAVG AVFNIWVMMI ANLFGFCLGS DGTKKLLSDM FCTVSGFKFV ILASVSLFIA    540
VQIMFEIREE EKRHGIYLKC                                                560

SEQ ID NO: 133
atgaatagga ttctatctag tgcatcgttg ctatccaatg ttagcatgcc aaggcaaaac     60
aagcataaaa ttcaaaggc gttatgttat gcaattatag tagcctcaat cggttcaata    120
caatttggtt accactgtc ggaattaaat gcacctcagc aggtgctttc gtgctcagaa     180
tttgacattc ccatggaggg ctatcccttat gacagaacat ggctgggaaa agaggatat    240
aagcaatgta taccattgaa tgatgaacag attggaatcc tgacctccgt ttttttgcatt   300
ggaggcattt tgggctctta ttttgccacc agtctggcca atatttatgg aaggaagttc    360
tcaagtttaa ttaactgcac attgaatatc gtcggttcgc tgataatctt caattcgaat    420
agttataggg gctaatcat tggtagaatt ctagtggta tttcgtgtgg ctctttgatc     480
gtgattatac ccctttcat taaggaagtt gctccaagcg gttgggaagg tttactgggt    540
tcgatgacac aaatctgtat caggttaggg gtcttgttga cacaaggaat agccctccca    600
ctgactgatt cataccgttg gaggtggatt tgtttggta gcttcctat cgcggtattg      660
aatttttca tgtggtttat agtcgatgaa tctccaaaat ggttgttagc acatggaaga    720
gtcaccgatg ctaagttatc tctatgtaag ctactggcg tgacttttga tgaagccgaa    780
caagagatac aggattggca actgcaaata gaattggggg atccgttgat tgaaccaacc    840
accacgaact ctattagcgg ttctaattca ttatggaat acttgaggga cagaacaaat    900
gtcaagtctc gccatgttat cactgtattg ttatttggcc aacaattctg cggtataaac    960
tccattgtac tatatggtac caagataatt agtcaactgt atcctcagca cgcaattagg   1020
ataaactttt tcattagtat ggtgaatgta ttagtcacca tactagtttc tctgctaatt   1080
```

TABLE 3-continued

Sequences disclosed herein.

```
catagtttgc cacgtaaacc gcttctgatg acgtccaccg tcttagtttc tgttaccgcc  1140
ttcattatgg gaatagcaat gaaccataat aaaatgaacc ttttgattgt gttttcattt  1200
atatatatgg gcgttttcac gatggggtta aatccgttgc catttataat aatgagagaa  1260
gtatcaaaac cacaggatat ggtccttgcg caaagatatg gtaccatttg caattgggta  1320
ggaactttta tcattgcata tactttccct attattcatg atgttttgtc aggttatgtt  1380
ttcatcattt ttgctatcat agcatgctca ataagcgcct ttatctggaa gaaggttccg  1440
gagaccaaga ggagcggcta a                                             1461
```

SEQ ID NO: 134
```
MNRILSSASL LSNVSMPRQN KHKITKALCY AIIVASIGSI QFGYHLSELN APQQVLSCSE    60
FDIPMEGYPY DRTWLGKRGY KQCIPLNDEQ IGIVTSVFCI GGILGSYFAT SLANIYGRKF   120
SSLINCTLNI VGSLIIFNSN SYRGLIIGRI LVGISCGSLI VIIPLFIKEV APSGWEGLLG   180
SMTQICIRLG VLLTQGIALP LTDSYRWRWI LFGSFLIAVL NFFMWFIVDE SPKWLLAHGR   240
VTDAKLSLCK LRGVTFDEAA QEIQDWQLQI ESGDPLIEPT TTNSISGSNS LWKYLRDRTN   300
VKSRHVITVL LFGQQFCGIN SIVLYGTKII SQLYPQHAIR INFFISMVNV LVTILVSLLI   360
HSLPRKPLLM TSTVLVSVTA FIMGIAMNHN KMNLLIVFSF IYMGVFTMGL NPLPFIIMRE   420
VSKPQDMVLA QRYGTICNWV GTFIIAYTFP IIHDVLSGYV FIIFAIIACS ISAFIWKKVP   480
ETKRSG                                                              486
```

SEQ ID NO: 135
```
atgaaaggcg aacctaagac ttacagcatg agcgacctct catactacgg tgagaaagca    60
caacaacaga acgagaaaca gcaaaaacaa tatgttgtga gacgaaattc tacgcagtca   120
acatcaaaac aaaacgtgag cgtggtgctc gaggacaacg ccagcgaaag taatgaacta   180
cctaaagggt ttatcttgta cgcatctttg atagcattgg cttttgtcgct gtttctggca   240
gccttggata tcatgatagt ttctacaatc attgaagaag tagctaaaca gtttggatcg   300
tactctgaga tcgggtggtt atttaccggg tatagcttac aaacgctct gttggcgttg   360
atatggggaa gaattgccac acctatcgga ttcaaggaga ccatgctatt tgctattgtc   420
attttttgaaa tcgggtcgct gatctctgct ttagcaaatt caatgagtat gctcattgtt   480
ggtagagtta ttgctggagt cggcggttgc ggtattcaaa gtttatcgtt cgtcattggt   540
tcaaccctgg tagaggagtc gcagagaggc atactaattg ctgttttgag ttgttcgttt   600
gctattgcat ctgttgttgg gcctttcctt ggaggagttt tcacctccag cgtcacatgg   660
agatggtgct tctatgttaa tttaccgatc ggtggcctag cattttctt attcctgttc   720
ttttataacc caggttaag tacatttcaa gagacaatgg ataacatccg caaatttcca   780
tcacagttta tcgaaattgt tcgaatgta gcatatcatt tattgaaaat caagggtttt   840
agcaaactta atgggtggag aaagccgttc atggaattga ttttcatgta tgatattatc   900
gagtttgtgt tttgttcagc tggattcaca tgtattctat tggcttttcac atttggcggt   960
aaccggtatg cttggaactc tgcatccatc attattcttt tcatcatcgg tatagtcctg  1020
gtagtgttag caggtatcta tgatttcctt gtcttcccca aatttaatat agtgaaagca  1080
acaccacatt accaaccatt aatgtcatgg acaaatatca gaaaccagg tattttcacg  1140
gttaatatag ccttgtttct cacttgtgca ggatatatca gtcagtttac gtatattgtg  1200
caatacttcc aattaattta caatgattcc gcctggagag ccgctgtaca cctggttgct  1260
tgcattattt ctacagtcgt tacagcaata cttttgcggtg ctatcaccga caaaacccgc  1320
caaatcaaac cgattattgt tatttcaagc attttttggtg ttgttggtgc gggtatatta  1380
accctattga acaataatgc caataactct gctcacatcg gcctttttgat attacctgcc  1440
gttgctttcg gtggtttggc acaaagtccc atgctcgctt ctcaaattca gttagacaag  1500
aagagcccaa cttttcgatc agattttgtc tctattacca cttttaacac attttgcaaa  1560
aatctaggtc aagcactggg aggtgtcatc tctaacactg ttttcagtgc tgctgctatc  1620
aagaaattaa ccaaggctaa tattcagctc ccagatggca ccacggtaga caatctggta  1680
atctataggc agaccaattt cgatggctct cattccaaat tgggcaatat aatttctgaa  1740
tctctcactg acgtctttta catggcatta ggatttatg cattatctct catttttgct  1800
gttttttgctt caaataagaa agtcacagca agcctgagat aa                    1842
```

SEQ ID NO: 136
```
MKGEPKTYSM SDLSYYGEKA QQQNEKQQKQ YVVRRNSTQS TSKQNVSVVL EDNASESNEL    60
PKGFILYASL IALALSLFLA ALDIMIVSTI IEEVAKQFGS YSEIGWLFTG YSLPNALLAL   120
IWGRIATPIG FKETMLFAIV IFEIGSLISA LANSMSMLIG GRVIAGVGGC GIQSLSFVIG   180
STLVEESQRG ILIAVLSCSF AIASVVGPFL GGVFTSSVTW RWCFYVNLPI GGLAFFLFLF   240
FYNPGLSTFQ ETMDNIRKFP SQFIEIVRNV AYHLLKIKGF SKLNGWRKPF MELIFMYDII   300
EFVFCSAGFT CILLAFTFGG NRYAWNSASI IILFIIGIVL VVLAGIYDFL VFPKFNIVKA   360
TPHYQPLMSW TNIKKPGIFT VNIALFLTCA GYISQFTYIQ QYFQLIYNDS AWRAAVHLVA   420
CIISTVVTAI LCGAITDKTR QIKPIIVISS IFGVVGAGIL TLLNNNANNS AHIGLLILPG   480
VAFGGLAQSS MLASQIQLDK KSPTFRSDFV SITTFNTFCK NLGQALGGVI SNTVFSAAAI   540
KKLTKANIQL PDGTTVDNLV IYRQTNFDGS HSKLGNIISE SLTDVFYMAL GFYALSLIFA   600
VFASNKKVTA SLR                                                      613
```

SEQ ID NO: 137
```
atgtctaaac aatttagtca taccaccaac gacagaagat catcgattat ctactccacc    60
agtgtcggga aggcagggct tttcacgcct gcagactaca tcccacagga gtcagaagaa   120
aacttaattg agggcgaaga gcaagagggt agtgaagaag aaccttccta taccggtcaa   180
gacgatgaga cggagaggga aggtaatac cattcgttgt tagatgccaa caattcgcgg   240
acattgcaac aagaagcgtg gcaacaaggt tatgactctc acgaccgtaa gcggttgctt   300
gacgaagaac gggacctgct aatagacaac aaactgctct ctcaacacgg caacggtggg   360
ggagatatag aaagtcacgg acatggccaa gcaattgaac cggacgagga agaaagacca   420
gctgagattg caaatacgcg ggagagcgcg atcgagagtg gtcagaaaat cagcacaact   480
tttaagagag aaacgcaagt gatcacgatg aatgcgttgc cgctaatctt caccttttatc   540
ttgcaaaatt cgttgtcact agcatctatt ttctccgtct cacatttagg gacgaaagag   600
ctaggtggtg ttacactcgg ttctatgact gctaacatca cggtcttgc tgctattcaa   660
ggtctgtgta catgtctgga cacactgtgt gcgcaggcat acggtgccaa aaactaccac   720
```

TABLE 3-continued

Sequences disclosed herein.

```
ttggtgggtg tgctagtgca gagatgtgct gtgatcacca tcttggcgtt cttgccaatg    780
atgtatgttt ggtttgtttg gtcggaaaag atcctagcac taatgattcc ggagagagaa    840
ctatgcgcgc tagcggctaa ctatcctacgt gtaaccgcat tcggtgtgcc aggattcatc    900
cttttttgaat gtggtaagag gttcctacaa tgtcaaggta tattccatgc atccacaatc    960
gtgctctttg tgtgcgcacc cttgaacgca ttgatgaact acttacttgt ttggaatgac   1020
aagattggga ttgggtacct tggtgcgcca ttatcggttg tgatcaacta ctggttgatg   1080
acgctcggat tactaatata cgcaatgacc accaagcaca aggagagcc actcaaatgc   1140
tggaatggta tcatccctaa ggaacaagca tttaagaact ggcgtaagat gattaaccta   1200
gctattcccg gcgtggtgat ggtggaggca gagttcctcg gctttgaagt gttgacaatt   1260
ttcgcttccc atctgggcac cgatgccttg gcgctcagt cgattgtggc tacgattgcg   1320
tctcttgcat accaagtgcc tttctctatc tccgtttcta ccagtacacg tgtagccaat   1380
tttatcggcg cgtcgctata cgacagctgc atgatcacgt gccgcgtgtc cttattgttg   1440
tcctttgtgt gctcctcaat gaacatgttc gttatctgcc gttataagga caaatcgca    1500
agtctatttt ctactgagag cgctgtagtg aagatggtcg tggacacact acctcttctt   1560
gcgttcatgc aattattcga tgcctttaat gcgtccaccg ccggatgcct acgtggtcaa   1620
gggagacaaa aaaataggtg ggtacatcaa cctagtcgca ttctactgcc taggtgtgcc   1680
catggcatat tgttagcat tcctgtatca tctgggtgta ggcggcttat ggttgggtat   1740
aactag                                                              1746

SEQ ID NO: 138
MSKQFSHTTTN DRRSSIIYST SVGKAGLFTP ADYIPQESEE NLIEGEEQEG SEEEPSYTGN    60
DDETEREGEY HSLLDANNSR TLQQEAWQQG YDSHDRKRLL DEERDLLIDN KLLSQHGNGG   120
GDIESHGHGQ AIGPDEEERP AEIANTWESA IESGQKISTT FKRETQVITM NALPLIFTFI   180
LQNSLSLASI FSVSHLGTKE LGGVTLGSMT ANITGLAAIQ GLCTCLDTLC AQAYGAKNYH   240
LVGVLVQRCA VITILAFLPM MYVWFVWSEK ILALMIPERE LCALAANYLR VTAFGVPGFI   300
LFECGKRFLQ CQGIFHASTI VLFVCAPLNA LMNYLLVWND KIGIGYLGAP LSVVINYWLM   360
TLGLLIYAMT TKHKERPLKC WNGIIPKEQA FKNWRKMINL AIPGVMVEA EFLGFEVLTI    420
FASHLGTDAL GAQSIVATIA SLAYQVPFSI SVSTSTRVAN FIGASLYDSC MITCRVSLLL   480
SFVCSSMNMF VICRYKEQIA SLFSTESAVV KMVVDTLPLL AFMQLFDAFN ASTAGCLRGQ   540
GRQKNRWVHQ PSRILLPRCA HGICVSIPVS SGCRRLMVGY N                       581

SEQ ID NO: 139
atgaagactc agtactctct aatacgaaaa atttgggcac attcagtaac agaatttctg     60
aaatcccagt ggttttttcat ctgtttggct attttaatcg ttattgcaag atttgctccg   120
aattttgcaa gagacggagg gttaattaaa ggccaatata gtattgggta cggctgcgtc   180
gcctgagttt ttctccaaag tggcctggga atgaaatgca ggtcactaag gcaaatatg    240
ttaaattgga gagctcatgc cactattctg gttctgagtt tccttattac ctcgtccata   300
gtatatggat tttgttgcgc ggtaaaggct gctaatgatc cgaaaataga tgactgggta   360
cttatcggtc taattttgac tgccacttgt ccaacaaccg tggcttcaaa cgttatcatg   420
actacaatg caggtggaaa tagccttttg tgcgtttgtg aagtattcat tggaaatttg    480
ttgggtgcgt ttattacacc tgcattggtt caaatgttta ctaaccgcgc acctttgca    540
tacggcaacc tgccactgg aaatggcatt ggtgcgcttt atggccgtgt tatgaaacag    600
gttggtctct ctgtattcgt acccttgttt gtgggtcagg ttattcaaaa ttgctttccg   660
aagggtactg cttattacct gggctttttg aaaaaatacc atattaaaat tggatcttac   720
atgcttttat tgattatgtt tagttcattc tcaactgcct tttatcagga tcgtttact    780
agcgtttctc atgtttgcat catattctc tgctttttta atttgggaat ttatatattc   840
ttcacgggtc tgtcatactt atgtgcaagg ccatggttca tcctcaagct tttcccctcat   900
gaaccaatag agggcaaatc tacaagattg taccgctact cgtataatat cttaggcct    960
ttttattatt caaaggaaga tgcgatttgc attatgtttt gtggcccggc taaaactgca  1020
gcactgggtg tatcactaat tacttcacaa tacggcgata aaaaagaaca cctgggtaag  1080
ttgttggttc cccttggtttt atatcaagtt gagcaagtca tgacggcaaa ttttcttgta  1140
agcttgttca aaagatggat acaaaaggac gctcaagcag acggaagcga gtcatcctgt  1200
gcaaatgaga atgaggaagt tgatttggaa aagatcatat caattggaac tggtgaaaat  1260
caatccgttc tgtcgaacaa cgtcccatat acacaaccaa ggtga                 1305

SEQ ID NO: 140
MKTQYSLIRK IWAHSVTEFL KSQWFFICLA ILIVIARFAP NFARDGGLIK GQYSIGYGCV    60
AWIFLQSGLG MKSRSLMANM LNWRAHATIL VLSFLITSSI VYGFCCAVKA ANDPKIDDWV   120
LIGLILTATC PTTVASNVIM TTNAGGNSLL CVCEVFIGNL LGAFITPALV QMFTNRAPFA   180
YGNPATGNGI GALYGRVMKQ VGLSVFVPLF VGQVIQNCFP KGTAYYLGFL KKYHIKIGSY   240
MLLLIMFSSF STAFYQDAFT SVSHVCIIFL CFFNLGIYIF FTGLSYLCAR PWFILKLFPH   300
EPIEGKSTRL YRYSYNIFRP FYYSKEDAIC IMFCGPAKTA ALGVSLITSQ YGDKKEHLGK   360
LLVPLVLYQV EQVMTANFFV SLFKRWIQKD AQADGSESSC ANENEEVDLE KIISIGTGEN   420
QSVLSNNVPY TQPR                                                     434

SEQ ID NO: 141
atggacaaat ataccaacag ggatcatccg gactatattc ctggcacatt taacatctat     60
tcttcccaaa atttggaaaa tggtattata tacgaatcaa aattgaagaa aacctcctca    120
ggagtcgtcc taatccctca accatcatac tcgccaaatg atccactgaa tcggtctagc    180
tggaggaaat tggctcattt tggtctaatg gcctttataa ctgcgtttac cgccgctact    240
agtaacgacg ctggtgctgc tcaagactca ttgaatgaga tttatgggat atcctacgat    300
tccatgaaca caggggctgg tgttcttttc ctaggtattg ttggtccac tttattcttg    360
gctccatttg ctaacttgta tggcaggaag attacgtaca tagtttgcac cacattaggt    420
ctctttggtg cgctttggtt tgctttggct aaaagaacga gcgacacaat atggtctcag    480
ttgtttgtag gtattagtga gtcctgtgct gaagcccagg tgcaactgtc cctgagcgac    540
attttttttcc agcaccaatt gggctccgta ttgaccgtgt atatcatgtg cactagtatc    600
ggtacgttct gggccatt gatcgctggg tacatatctg catttaccaa cttccgttgg    660
gtcggttggg tcgcagtgat catatctggt ggccttttaa taactattat atttggctgc    720
```

TABLE 3-continued

Sequences disclosed herein.

```
gaagaaacgt acttcgacag aggccagtat atgaccccctt tgaccagctg tcaatcggga       780
tacgaagacg gtaccacttt acaaaactct gacaatacgg ccgtgtcgcg caggaaacgt       840
catcttgacg ctaaattatc aactcctgga gccatgggtg agaaaggtgt agacctttca       900
gagacggctg aattcgaagt taacaatgaa gaggaagtta ccatacctga gactcgcgaa       960
ttgattgatg gttcaaaaga gcatttgaaa ccatacccaa aaagagtagc aatattaacc      1020
aaagctacta atttgaaagg ctacggtttt aaacagtatt tcaaatatct aaagatcaac      1080
cttagaatgt tcttattccc gccagtgtgg ttgtctggta tgttttgggg tattcaagac      1140
gttttcctga cgtttatttt gaccactcaa gaaagcgcct actacgaacc tccatggaac      1200
tatagtgatt ttggtgtcgc aattatgaat gttcccacac ttattggagc agtcatcggt      1260
tgtatctgtg ctggcattgt tagtgactac tttgttcttt ggatggctcg tcacaataga      1320
ggaattttag aggcagaatt tagactatac ttctctatcg caactgcaat tattgggcca      1380
gcgggtttgc tgatgtttgg tatcggtacc gctagacaat ggccttggca agctatatac      1440
gtcgggttgg gttttgttgg gttttgcatgg ggttgttctg gtgatattgc gatggcgtat      1500
ttaatggatt gttaccccga tatggttttg aaggtatgg tttgtactgc tattattaac      1560
aacacgatat cttgcatttt caccttttacc tgttctgatt ggctagctgc atctggtact      1620
gaaaatactt acattgcttt agctgtcatc aactttggga ttactgcatt tgctttacca      1680
atgtactact atggtaagag gataagactt tggactaaga gatggtattt gcaatctgtc      1740
aatttgagag acggtgtgta a                                                1761

SEQ ID NO: 142
MDKYTNRDHP DYIPGTFNIY SSQNLENGII YESKLKKTSS GVVLIPQPSY SPNDPLNWSS        60
WRKLAHFGLM AFITAFTAAT SNDAGAAQDS LNEIYGISYD SMNTGAVLF LGIGWSTLFL        120
APFANLYGRK ITYIVCTTLG LFGALWFALA KRTSDTIWSQ LFVGISESCA EAQVQLSLSD       180
IFFQHQLGSV LTVYIMCTSI GTFLGPLIAG YISAFTNFRW VGWVAVIISG GLLITIIFGC       240
EETYFDRGQY MTPLTSCQSG YEDGTTLQNS DNTAVSRRKR HLDAKLSTPG AMGEKGVDLS       300
ETAEFEVNNE EEVTIPETRE LIDGSKEHLK PYPKRVAILT KATNLKGYGF KQYFKYLKIN       360
LRMFLFPPVW LSGMFWGIQD VFLTFYLTTQ ESAYYEPPWN YSDFGVAIMN VPTLIGAVIG       420
CICAGIVSDY FVLWMARHNR GILEAEFRLY FSIATAIIGP AGLLMFGIGT ARQWPWQAIY       480
VGLGFVGFAW GCSGDIAMAY LMDCYPDMVL EGMVCTAIIN NTISCIFTFT CSDWLAASGT       540
ENTYIALAVI NFGITAFALP MYYYGKRIRL WTKRWYLQSV NLRDGV                      586

SEQ ID NO: 143
atgaccgaag actttatttc ttctgtcaag cgttcaaatg aggagctgaa ggagcgaaaa        60
tctaactttg gatttgtaga atacaaatcc aagcaattaa catcatcctc atcacacaat       120
tcaaactcat cgcatcacga tgatgacaac caacacggca gaggaatat tttccagcga       180
tgtgttgatt ctttcaagtc tcctctggac ggctcgttcg acacaagtaa tttgaagagg       240
actctgaaac caaggcactt aatcatgatt gccattgggg gcagtatagg tactggtttg       300
tttgtcggta gtggtaaggc aatcgccgaa ggtggtcctc ttggtgtcgt cattggttgg       360
gctattgcag gctctcaaat catcgggacg attcatgggc taggtgaaat cacggtgcgg       420
ttcccccgttg tcggggcctt tgccaattac ggcacaaggt ttttggatcc aagtataagt       480
tttgttgttt cgaccatata cgtgctacag tggtttttg tattacccctt agaaatcatt       540
gcggcggcaa tgaccgtaca gtactggaac tcgtctattg accccgtaat ttgggtagcc       600
atcttttatg ctgttattgt ttccataaat ttgtttggtg tacgaggttt tggggaagcg       660
gaatttgcat tttccaccat aaaagcaata acagtttgtg gattcattat attgtgcgtt       720
gtcctcattt gcggtggagg tcccgaccac gagttcattg gcgccaaata ctggcacgac       780
cctggttgtt tggccaatgg gttcccgggc gttctatctg ttcttgttgt tgcttcgtat       840
tctctcggtg gtatagaaat gacgtgcctg gcatcaggtg aaacggaccc caaaggctta       900
ccaagtgcta tcaagcaagt gttttttggagg atcttatttt tcttttttgat atcactgacn       960
ctggtaggat tcctggttcc atatacaaac caaaacttac tgggtggttc atctgtggac      1020
aactcacctt ttgtcattgc cataaaaattg catcacatta aagccttgcc ctccatcgtc      1080
aatgcggtca tccttatcag tgttttgagt gtaggtaact cctgcatctt cgcttcaagt      1140
agaacgttgt gttcgatggc ccaccaaggc cttattcgat ggtggtttgg ttatatcgaa      1200
cgtgctggta ggccactggt tggcattatg gcaaattcac tatttggatt actagcatt       1260
ctggtcaaat ctggctcgat gtctgaagtt ttcaattggt taatggccat tgccggcctg      1320
gccacgtgca ttgtctggtt gagcatcaac ctgtcacata tcagatttag actggcgatg      1380
aaggctcaag ggaagtctct ggatgaatta gaatttgtta gtgctgtcgg gatttgggga      1440
tcagcgtatt ccgctttaat caactgtcta atcttgatag ctcaattcta ttgttcacta      1500
tggcccattg gtggctggac cagcggcaaa gaaagggcta aaatatttt tcaaaattat       1560
ctgtgtgcct taatcatgtt atttatattc atcgtccaca aaatttatta caagtgtcaa      1620
acaggcaaat ggtgggggt taaggcgtta aggacatag atttggaaac cgatcgtaaa      1680
gatatcgaca tcgaaatagt caagcaagaa attgccgaaa agaaaatgta cctagattcc      1740
cgtccatggt acgtgagaca gttccatttc tggtgttaa                             1779

SEQ ID NO: 144
MTEDFISSVK RSNEELKERK SNFGFVEYKS KQLTSSSSHN SNSSHHDDDN QHGKRNIFQR        60
CVDSFKSPLD GSFDTSNLKR TLKPRHLIMI AIGGSIGTGL FVGSGKAIAE GGPLGVVIGW       120
AIAGSQIIGT IHGLGEITVR FPVVGAFANY GTRFLDPSIS FVVSTIYVLQ WFFVLPLEII       180
AAAMTVQYWN SSIDPVIWVA IFYAVIVSIN LFGVRGFGEA EFAFSTIKAI TVCGFIILCV       240
VLICGGGPDH EFIGAKYWHD PGCLANGFPG VLSVLVVASY SLGGIEMTCL ASGETDPKGL       300
PSAIKQVFWR ILFFFLISLT LVGFLVPYTN QNLLGGSSVD NSPFVIAIKL HHIKALPSIV       360
NAVILISVLS VGNSCIFASS RTLCSMAHQG LIPWWFGYID RAGRPLVGIM ANSLFGLLAF       420
LVKSGSMSEV FNWLMAIAGL ATCIVWLSIN LSHIRFRLAM KAQGKSLDEL EFVSAVGIWG       480
SAYSAYSALINCL ILIAQFYCSL WPIGGWTSGK ERAKIFFQNY LCALIMLFIF IVHKIYYKCQ    540
TGKWWGVKAL KDIDLETDRK DIDIEIVKQE IAEKKMYLDS RPWYVRQFHF WC              592

SEQ ID NO: 145
atgtcacagc aggagaatgg tgatgtggcc actgaattaa tcgaaaatag actttccttc        60
tcaagaatcc ctagaataag ccttcatgta aagggattgt caatcgttgc atccaaaaca       120
```

TABLE 3-continued

Sequences disclosed herein.

```
aatacgacgc tagttaatac gttttccatg gacctgccca gtgggtcggt catggcagtt    180
atgggtggtt cggggtcagg gaagactacg ttgctgaatg ttctggcatc caagatcagt    240
ggtgggttaa ctcataatgg ttctatacgg tacgtattgg aagatacagg ttcagaaccc    300
aatgaaacag agcctaagag ggctcacttg gatggccaag accatcccat ccagaaacac    360
gtaataatgg cgtacctacc tcaacaagat gtactctctc ctaggttgac ttgtagagaa    420
actcttaagt ttgcagctga tttgaaacta aactcttctg agcgaaccaa gaaattaatg    480
gtcgagcaat taattgaaga attgggagctc aaggattgtc ccgatactct tgtggggggac    540
aactcgcaca ggggtctttc tggtggtgaa aagagaagac taagtattgg tactcaaatg    600
atttcaaacc cttccatcat gttcttagat gagcctacca ctggactgga tgcatattct    660
gccttcttgg ttattaaaac tttgaaaaaa ttagctaaag aagatggcag gacttttatc    720
atgtcaattc atcagccgag atcggatata ttgttttat tggaccaggt ttgtattttg    780
tcaaagggaa atgtggtata ttgtgacaaa atggataata ctatcccta ttttgagtct    840
attggttatc acgtaccccca gctggtaaat ccagcagatt atttcattga tttatcaagc    900
gtagactcta gatctgataa agaagaagct gccacgcaaa gtcggctaaa ttcattgatt    960
gatcattggc atgattatga gagaactcat ttgcaactac aggcagaatc ttatataagc   1020
aacgcaacgg aaattcaaat tcagaatatg actaccagac tgccattttg gaagcaagtt   1080
acggtgctaa caaggcgaaa tttcaaatta aattttcag attacgttac ttaatatct   1140
acttttgcag aaccgttgat tattggtact gtttgcggtt ggatttacta taaacctgac   1200
aaaagcagta taggtggttt aaggacaaca accgcatgtc tttacgcgtc cacaattttg   1260
caatgttact tgtatttgct ttttgatact tatcgacttt gtgagcagga tattgcgtta   1320
tatgacagag aaagagcaga gggctcggta cacctttgg cattcatcgt agctagaaaa   1380
atttcacttt tcctctctga cgatttcgcg atgaccatga tttttgtcag tataacatat   1440
tttatgtttg gattggaagc agatgcaagg aagtttttt atcagtttgc tgttgtattt   1500
ttatgtcagc tatcatgttc cggtttatct atgttatcgg tggcggtatc gagagatttt   1560
tctaaagctt cattagtagg aaatatgaca tttacggtat tatcgatggg atgtggtttt   1620
ttcgttaatg ctaaagtaat gcccgtgtat gttcgttgga ttaaatatat tgcctttacg   1680
tggtattcat tcggtactct catgtcaagc accttacga ttctactg tactacagat   1740
aatctcgatg agtgcttggg taaccagata ttggaagttt acgggtttcc taggaattgg   1800
ataaccgtac ctgccgttgt cttactttgc tggtctgtgg atattttgt agtaggtgca   1860
attattttat atttgcacaa gattgatata actttacaaa atgaagtgaa atcgaagcaa   1920
aaaaaaatca aaagaaatc cccaacagga atgaaacccg agattcagct gctagatgac   1980
gtgtatcatc agaaagattt ggaagcggag aaaggaaaaa atatacatat tactataaa   2040
ttagaagata tagacttacg agtcattttt tctgcccctt tctcaaactg aaagaaggc   2100
aacttccacc atgaaacaaa agaaattcta caatcagtta atgccatttt caaacctgga   2160
atgattaatg caattatggg gccatcaggg tctgaaagt cttctctgtt aaacctaatc   2220
tccggaagat taaaatcttc ggtctttgcc aaatttgaca cttcaggttc aataatgttc   2280
aatgatattc aagtttcaga gcttatgttt aaaaatgtat gctcgtatgt ctcgcaggat   2340
gatgaccacc ttttggcagc tttaaccgtt aaagaaaccc tgaaatatgc cgctgcatta   2400
agattgcatc atctgactga ggcagaacga atggagagaa ctgacaacct aataaggtct   2460
ttgggtttaa agcattgtga aaacaatatc attgtaagtt aatttgttaa aggtataagc   2520
ggtggtgaaa aaagaagagt aactatgggt gtgcaattat taaacgatcc tccgatatta   2580
ttgctagatg aaccaacttc agggttagat agcttcacat ccgctactat actgaaatt   2640
ttggagaagt tatgtaggga acagggcaag acgatcatca ttaccattca tcaaccaagg   2700
tcagaattat tcaagagatt tggtaatgtt ttgctattag ctaaatcggg tagaactgct   2760
ttcaatggat caccgatga aatgattgct tatttcactg aattgggata taactgtcct   2820
tcgtttacga acgtggcaga tttctttctt gatttaattt cagttaatac ccagaacgaa   2880
cagaatgaaa taagctcaag ggcacgagta gaaaagatac ttagtgcatg gaaagctaat   2940
atggataacg aaagcctttc accaacccca atttctgaaa aacaacaata ctctcaggag   3000
tcatttttca cagaatacag cgagtttgta agaaaaccag ctaatttggt tttggcgtac   3060
atagtgaacg ttaaaaggca atttactacg acaaggagaa gttttgactc tttgatggcg   3120
cgtattgcac aaaattccagg attaggtgtt attttcgcat tattctttgc cccagtcaag   3180
cataattata caagtattag caatcgtcta ggattggcac aagaatctac agcactatat   3240
tttgtgggca tgctggggaa cttggcatgt tatccaactg aaagagatta cttttacgaa   3300
gaatataatg ataatgttta tggtatagca cctttttct tagcttatat gacattagag   3360
ttgccgctat ccgcattagc ttcagtgtta tacgcggtat ttacagtact ggcatgtggg   3420
ttaccaagaa ctgcaggcaa cttctttgca accgtctact gttcctttat tgttacctgt   3480
tgtgggaag ctcttggtat aatgacaaat acatttttcg aaaggccagg cttcgtcgtt   3540
aactgcattt ccattatttt atccattggt actcagatgt cagggttaat tgcactaggc   3600
atgtcgagag tattaaaggg tttaactat ttgaaccctg tagggtatac atctatgatc   3660
atcattaatt tcgcattccc aggtaatttg aaattaaccct gcgaagatgg cgggaaaaat   3720
tcagacggta cttgtgaatt tgcgaatggc catgatgtgt tggtttctta tggtttagtc   3780
agaaatacgc aaaagtacct gggaatcatt gtgtgcgtag ccataattta tcgccttatt   3840
gcatttttta ttttaaaagc aaaattggag tggataaaat ggtga              3885
```

SEQ ID NO: 146

```
MSQQENGDVA TELIENRLSF SRIPRISLHV RDLSIVASKT NTTLVNTFSM DLPSGSVMAV     60
MGGSGSGKTT LLNVLASKIS GGLTHNGSIR YVLEDTGSEP NETEPKRAHL DGQDHPIQKH    120
VIMAYLPQQD VLSPRLTCRE TLKFAADLKL NSSERTKKLM VEQLIEELGL KDCADTLVGD    180
NSHRGLSGGE KRRLSIGTQM ISNPSIMFLD EPTTGLDAYS AFLVIKTLKK LAKEDGRTFI    240
MSIHQPRSDI LFLLDQVCIL SKGNVVYCDK MDNTIPYFES IGYHVPQLVN PADYFIDLSS    300
VDSRSDKEEA ATQSRLNSLI DHWHDYERTH LQLQAESYIS NATEIQIQNM TTRLPFWKQV    360
TVLTRRNFKL NFSDYVTLIS TFAEPLIIGT VCGWIYYKPD KSSIGGLRTT TACLYASTIL    420
QCYLYLLFDT YRLCEQDIAL YDRERAEGSV TPLAFIVARK ISLFLSDDFA MTMIFVSITY    480
FMFGLEADAR KFFYQFAVVF LCQLSCSGLS MLSVAVSRDF SKASLVGNMT FTVLSMGCGF    540
FVNAKVMPVY VRWIKYIAFT WYSFGTLMSS TFTNSYCTTD NLDECLGNQI LEVYGFPRNW    600
ITVPAVVLLC WSVGYFVVGA IILYLHKIDI TLQNEVSKQ KKIKKKSPTG MKPEIQLLDD    660
VYHQKDLEAE KGKNIHITIK LEDIDLRVIF SAPFSNWKEG NFHHETKEIL QSVNAIFKPG    720
MINAIMGPSG SGKSSLLNLI SGRLKSSVFA KFDTSGSIMF NDIQVSELMF KNVCSYVSQD    780
```

TABLE 3-continued

Sequences disclosed herein.

```
DDHLLAALTV KETLKYAAAL RLHHLTEAER MERTDNLIRS LGLKHCENNI IGNEFVKGIS    840
GGEKRRVTMG VQLLNDPPIL LLDEPTSGLD SFTSATILEI LEKLCREQGK TIIITIHQPR    900
SELFKRFGNV LLLAKSGRTA FNGSPDEMIA YFTELGYNCP SFTNVADFFL DLISVNTQNE    960
QNEISSRARV EKILSAWKAN MDNESLSPTP ISEKQQYSQE SFFTEYSEFV RKPANLVLAY   1020
IVNVKRQFTT TRRSFDSLMA RIAQIPGLGV IFALFFAPVK HNYTSISNRL GLAQESTALY   1080
FVGMLGNLAC YPTERDYFYE EYNDNVYGIA PFFLAYMTLE LPLSALASVL YAVFTVLACG   1140
LPRTAGNFFA TVYCSFIVTC CGEALGIMTN TFFERPGFVV NCISIILSIG TQMSGLMSLG   1200
MSRVLKGFNY LNPVGYTSMI IINFAFPGNL KLTCEDGGKN SDGTCEFANG HDVLVSYGLV   1260
RNTQKYLGII VCVAIIYRLI AFFILKAKLE WIKW                                1294

SEQ ID NO: 147
atgcctctat caaaggtgga gcactacctt tcataccata cgcgcttact cttaccccat     60
gttttgtctc ttcagtcatc acatcgtgtt gcatacatct tttcgctatt atctgcggtg    120
tcaactggct tcattacttt gatatctctt tactctcaac cgtggcagaa acatttaaat    180
tattcctcat ggcaaatcaa caccatcgct agtatgacta atttggggat gtacttgacg    240
ccaccaatct tggggatgat cgctgattcc catggcccca ttactttaag tcttttagcc    300
atcatagggt tcatacctag ctattcatat ctggcttacg ttttaatca tccggagtta    360
tctctcggag gaaatggtga ctcatcattc aatctatcca tcatttgttt cgttttcata    420
ggtatatcaa caagcgcttt atactttagc gcttactga catgcactaa gctatatcct    480
catacaaaac tactatccat tagcttacca acgacatgtt atggtatttc ttctgtagtc    540
ggttctcaac tgctaagaat caaatggttc tggtcctcta acgcaagttc ttcctcgtcc    600
aatagtgact taaacctggg aagagtattc caaacatttg ccctcgttta tgtcgttatt    660
gggctacttg catggatagc caccagcgtg gtatcctttt tgcattttaa tgaagagcaa    720
gacaaccaaa aacggctgga tgatcaaact gatgtggaac aatcaccgct gttagaacga    780
agtaatcatg ttcaagaaaa gtttacgcag acgatgctaa ggatctttag tgatcctgtg    840
acatatatcc tagcggtatc aattttgtta tcacttgggc ccctcgagat gtttattgcc    900
aatatgggat cactgactaa cctgctagtc caattagatg cgccaacctt atctacaaag    960
ttgttatcca catcgcgct atcttccact tttacgagat tgctcacagg catagtggca   1020
gacttcttcg ccaagaaaaa aatatcaatt aaatggatcc tgttgacttt cctttcatta   1080
ggggtatgtg cacaactgtt tttattgaaa atgacctctt cagcgtcacc ctgggggcta   1140
gtacctacag gatcattggt tggaattgta tacggtggac ttttcactgt ttatccgacg   1200
ctggtcctgt tagtatgggg cgaacgctca ttcgggactg tttacggtag ttactaatt    1260
gcacctgcta taggttctat gatattttgc atgttgtatg ccaaattta cgattctcgc    1320
tgtatgagtg gcggaggaga tctgcgaaat ccgtcctgta tttcggctgt ctacaagtac    1380
agcagtatcg cattcgttgt atccgctgtt ctttcagctg tagtattttg gaaattaaaa    1440
agtagaaaac tcagaattta a                                              1461

SEQ ID NO: 148
MPLSKVEHYL SYHTRLLLPH VLSLQSSHRV AYIFSLLSAV STGFITLISL YSQPWQKHLN     60
YSSWQINTIA SMTNLGMYLT PPILGMIADS HGPITLSLLA IIGFIPSYSY LAYVFNHPEL    120
SLGGNGDSSF NLSIICFVFI GISTSALYFS ALLTCTKLYP HTKLLSISLP TTCYGISSVV    180
GSQLLRIKWF WSSNASSSSS NSDLNLGRVF QTFALVYVVI GLLAWIATSV VSLLHFNEEQ    240
DNQKRLDDQT DVEQSPLLER SNHVQEKFTQ TMLRIFSDPV TYILAVSILL SLGPLEMFIA    300
NMGSLTNLLV QLDAPTLSTK LLSTYALSST FTRLLTGIVA DFFAKKKISI KWILLTFLSL    360
GVCAQLFLLK MTSSASPWGL VPTGSLVGIV YGGLFTVYPT LVLLVWGERS FGTVYGSLLI    420
APAIGSMIFC MLYAKFYDSR CMSGGGDLRN PSCISAVYKY SSIAFVVSAV LSAVVFWKLK    480
SRKLRI                                                              486

SEQ ID NO: 149
atggatgcaa ctaccccact attaactgtt gcgaacagtc atcccgcccg caatccaaag     60
cacactgcat ggagagcagc tgtgtatgat ttacagtata ttttgaaagc gtcacccctg    120
aatttcctat tggtatttgt tcctttaggt ctgattggg gacacttcca actatctcat    180
acactgacat ttcttttaa tttcttggca attataccgt tggcagctat cttggctaat    240
gccacgaag agttggctga taggctggt aacaccattg ggactgct aaatgctact    300
tttggtaacg ctgtggaact aattgtttct atcattgccc tgaaaaaagg tcaagtgaga    360
attgtgcagg cctcgatgct aggtagtctt ctttctaatt tgctgttagt gcttggatta    420
tgcttcatat tcggtggata caatagagtc aacagacat tcaaccaaac cgccgctcaa    480
acaatgtcct cattacttgc cattgcgtgt gcatccctac tgattccgc tgcctttaga    540
gccacccta ctcatggcaa ggaagaccac ttcatcgatg aaaaatatt ggagttatcc    600
agaggcacct ctattgttat tctcatcgtt tacgttttgt tcttatatt ccagctaggg    660
agccatcacg ccttgtttga gcaacaagaa gaagagaccg atgaagttat gagcaccatt    720
tccaggaatc cacatcactc tttgagtgtc aagtcatcat tggtgatact tcaggtaca    780
actgtgatca tctctttttg tgcggatttt ctagtcggta cgatagacaa cgttgttgaa    840
tctaccgggc tatctaaaac atttataggt tgattgtca ttcctattgt gggtaatgcc    900
gcagagcatg tcacttcagt cttggtggcc atgaaggata agatggatct ggcgctaggt    960
gttgccatcg cttcctcttt acaagttgcc ttatttgtta caccattcat ggttcttgta   1020
ggctggatga tcgatgttcc aatgacgcta aatttctcca cttttgaaac cgctactctt   1080
tttattgctg ttttccttatc caattactta attctcgatg tgagtcaaa ctggttggag   1140
ggtgtcatgt ctctagctat gtatattttg attgcaatgg cattttttcta ttatccagac   1200
gaaaaaaccc ttgactctat tggaaatagt ttatga                              1236

SEQ ID NO: 150
MDATTPLLTV ANSHPARNPK HTAWRAAVYD LQYILKASPL NFLLVFVPLG LIWGHFQLSH     60
TLTFLFNFLA IIPLAAILAN ATEELADKAG NTIGGLLNAT FGNAVELIVS IIALKKGQVR    120
IVQASMLGSL LSNLLLVLGL CFIFGGYNRV QQTFNQTAAQ TMSSLLAIAC ASLLIPAAFR    180
ATLPHGKEDH FIDGKILELS RGTSIVILIV YVLFLYFQLG SHHALFEQQE EETDEVMSTI    240
```

TABLE 3-continued

Sequences disclosed herein.

```
SRNPHHSLSV KSSLVILLGT TVIISFCADF LVGTIDNVVE STGLSKTFIG LIVIPIVGNA    300
AEHVTSVLVA MKDKMDLALG VAIGSSLQVA LFVTPFMVLV GWMIDVPMTL NFSTFETATL    360
FIAVFLSNYL ILDGESNWLE GVMSLAMYIL IAMAFFYYPD EKTLDSIGNS L             411

SEQ ID NO: 151
atgaaggatt taaaattatc gaatttcaaa ggcaaattta taagcagaac cagtcactgg     60
ggacttacgg gtaagaagtt gcggtatttc atcactatcg catctatgac gggcttctca    120
ctgtttggat acgaccaagg gttgatggca agtctaatta ctggtaaaca gttcaactat    180
gaatttccag caaccaaaga aaatggcgat catgacagac acgcaactgt agtgcagggc    240
gctacaacct cctgttatga attaggttgt ttcgcaggtt ctctattcgt tatgttctgc    300
ggtgaaagaa ttggtagaaa accattaatc ctgatgggtt ccgtaataac catcattggt    360
gccgttattt ctacatgcgc atttcgtggt tactgggcat taggccagtt tatcatcgga    420
agagtcgtca ccggtgttgg aacagggttg aatacatcta ctattcccgt ttggcaatca    480
gaaatgtcaa aagctgaaaa tagagggttg ctggtcaatt tagaaggttc cacaattgct    540
tttggtacta tgattgctta ttggattgat tttgggttgt cttataccaa cagttctgtt    600
cagtggagat tccccgtgtc aatgcaaatc gttttttgctc tcttcctgct tgctttcatg    660
attaaactac ctgaatcgcc acgttggctg atttctcaaa gtcgaacaga agaagctcgc    720
tacttggtag aacactaga cgacgcggat ccaaatgatg aggaagttat aacagaagtt    780
gctatgcttc acgatgctgt taacaggacc aaacacgaga aacattcact gtcaagtttg    840
ttctccagag gcaggtccca aaatcttcag agggctttga ttgcagcttc aacgcaattt    900
ttccagcaat ttactggttg taacgctgcc atatactact ctactgtatt attcaacaaa    960
acaattaaat tagactatag attatcaatg atcataggtg gggtcttcgc aacaatctac   1020
gccttatcta ctattggttc atttttttcta attgaaaagc taggtagacg taagctgttt   1080
ttattaggtg ccacaggtca agcagtttca ttcacaatta catttgcatg cttggtcaaa   1140
gaaaataaag aaaacgcaag aggtgctgcc gtcggcttat ttttgttcat tacattcttt   1200
ggtttgtctt tgctatcatt accatggata tacccaccag aaattgcatc aatgaaagtt   1260
cgtgcatcaa caaacgcttt ctccacatgt actaattggt tgtgtaactt tgcggttgtc   1320
atgttcaccc caatatttat tggacagtcc ggttgggatt gctacttatt ttttgctgtt   1380
atgaattatt tatacattcc agttatcttc tttttctacc ctgaaaccgc cggaagaagt   1440
ttggaggaaa tcgacatcat ctttgctaaa gcatacgagg atggcactca accatggaga   1500
gttgctaacc atttgcccaa gttatcccta caagaagtcg aagatcatgc caatgcattg   1560
ggctcttatg acgacgaaat ggaaaaagag gactttggtg aagatagagt agaagacacc   1620
tataaccaaa ttaacggcga taattcgtct agttcttcaa acatcaaaaa tgaagataca   1680
gtgaacgata aagcaaattt tgagggttga                                     1710

SEQ ID NO: 152
MKDLKLSNFK GKFISRTSHW GLTGKKLRYF ITIASMTGFS LFGYDQGLMA SLITGKQFNY     60
EFPATKENGD HDRHATVVQG ATTSCYELGC FAGSLFVMFC GERIGRKPLI LMGSVITIIG    120
AVISTCAFRG YWALGQFIIG RVVTGVGTGL NTSTIPWQS EMSKAENRGL LVNLEGSTIA    180
FGTMIAYWID FGLSYTNSSV QWRFPVSMQI VFALFLLAFM IKLPESPRWL ISQSRTEEAR    240
YLVGTLDDAD PNDEEVITEV AMLHDAVNRT KHEKHSLSSL FSRGRSQNLQ RALIAASTQF    300
FQQFTGCNAA IYYSTVLFNK TIKLDYRLSM IIGGVFATIY ALSTIGSFFL IEKLGRRKLF    360
LLGATGQAVS FTITFACLVK ENKENARGAA VGLFLFITFF GLSLLSLPWI YPPEIASMKV    420
RASTNAFSTC TNWLCNFAVV MFTPIFIGQS GWGCYLFFAV MNYLYIPVIF FFYPETAGRS    480
LEEIDIIFAK AYEDGTQPWR VANHLPKLSL QEVEDHANAL GSYDDEMEKE DFGEDRVEDT    540
YNQINGDNSS SSSNIKNEDT VNDKANFEG                                     569

SEQ ID NO: 153
atgagtgaca atccatttaa tgcgagtctt cttgacgagg actcaaaccg tgagagagaa     60
atactagatg ccacagcaga ggccctttcg aaaccaagcc cttctttaga gtattgtact    120
ttatccgtgg acgaagctct agaaaaactg gacactgaca aaaacggtgg tttacgatca    180
tctaacgagg ccaacaatag gagatcactt tatggcccca atgaaataac cgtagaagat    240
gatgaaagtc ttttcaagaa gttcttgtca aatttcattg aggatcgaat gattctactt    300
ttaataggat ccgcagtggt ctctcttttt atgggtaaca ttgatgatgc tgttagtatc    360
acactggcca ttttcatagt tgtcactgtc ggttttgtcc aagaatatag gtctgaaaaa    420
tctctagaag cgttgaataa attggttcct gctgaatgtc acttaatgag atgtggtcaa    480
gagagtcatg tactggcttc caccttggtt cctggtgatt tagtgcactt cagaataggt    540
gacagaatcc ccgcagacat tagaattatt gaagcaatcg atttatccat cgatgaaagt    600
aatttaactg gtgaaaatga accggtacat aaaacctcac aaacgatcga aaaatcttcc    660
tttaacgatc agcctaattc aattgtaccg atttctgaga gatcttgtat agcttatatg    720
ggtacattag tcaaggaagg tcatgtgtaag ggtatcgtct taggaacagg tacaaacaca    780
tcctttggtg ccgttttgta aatgatgaat aatattgaaa aaccgaagac tccattgcag    840
ttaacaatgg acaaatttggg aaaggacttg tcactggtta gcttcatagt tattggtatg    900
atttgtttag ttggtatcat acaaggtaga tcttggttag aatgttcca aatatcggta    960
tccttagcgg ttgctgctat tccagaaggg ttaccaatta ttgtcactgt tactttggca   1020
ttgggtgttc tgagaatggc caagcgtaaa gccatcgtga gaaggttacc aagtgtcgaa   1080
actttaggct ctgtcaacgt tatctgctcc gacaaaacag gtacactaac ctcaaaccac   1140
atgaccgtat ctaaactttg gtgcttggac agtatgtcca ataagctaaa cgtcctctca   1200
ttagacaaaa ataagaagac taaaaattct aatggaaatt tgaaaaacta tttgactgaa   1260
gacgttaggg aaactctaac tatcggtaat ctctgtaata atgcatcttt ctctcaagaa   1320
catgccatat ttctgggaaa tcctactgat gtagctcttt tagagcaatt ggcaaacttt   1380
gaaatgcctg atatcagaaa caccgttcaa aaagttcagg aacttccatt taactcgaaa   1440
agaaaattaa tggcaaccaa gattctcaac cctgtcaaca agttgtac agttttatgtt   1500
aaggtgcat tgaaagaat tcttgagtac tccacaagtt atttgaaatc aaagggtaaa   1560
aaaactgaaa agttgactga agcccaaaaa gctacgataa atgagtgcgc aaattctatg   1620
gcatctgaag gtttcgtgt ctttggattt gctaaactaa ctttgtctga ttcatcaact   1680
cctctaaccg aagacctaat caaagattta accttactg gtttaatcgg tatgaatgac   1740
ccaccaagac cgaacgttaa atttgccatc gaacaattac tacaaggtgg tgtccatatt   1800
```

TABLE 3-continued

Sequences disclosed herein.

```
attatgatca ctggtgattc tgagaatacc gcagtaaaca ttgcaaaaca aattggtatt   1860
ccagttattg atccaaagct ttccgtttta tccggtgata aattagatga aatgtcagat   1920
gatcaactgg ccaatgtcat cgaccacgtt aatattttg ctcgtgctac gcctgagcat   1980
aagttaaaca ttgttcgtgc attaagaaag aggggtgatg tggtagcaat gactggtgat   2040
ggtgttaacg acgctcctgc gttgaaactt tcagatattg tgtttctat gggtagaatt   2100
ggtacagatg tagccaaaga agcctcgat atggtcttaa ctgatgatga cttcagtact   2160
attttaactg ccattgaaga gggtaaaggt atctttaata atattcagaa tttcctgact   2220
tttcaattgt ctacttctgt tgccgcacta tcattagttg cactatctac agcgtttaaa   2280
ctacccaatc cactgaacgc aatgcaaatt ctttggataa atattttaat ggatgggcca   2340
ccagctcaat ccttaggtgt ggaacctgtt gatcatgaag ttatgaaaaa acctccaaga   2400
aaacgtaccg ataaaatttt gacccatgat gtaatgaaac gtttactaac caccgcgcc   2460
tgtatcatcg ttgggacagt ttacatttt gttaaagaga tggccgaaga tggtaaagta   2520
actgctagag atactactat gacatttact tgttttgttt ttttgatat gtttaatgct   2580
ttggcctgca gacataacac aaagtcaatc ttcgaaatcg gctttttcac gaacaaaatg   2640
ttcaactacg ccgttggact gtctctgtta gtcaaatgt gcgctatata tataccattt   2700
ttccaaagta tctttaaaac tgagaaactt ggtatctctg atatactatt gttattgctc   2760
atcagcagta gcgttttcat cgttgatgaa ttgagaaaat tgtggacgag aaaaagaat   2820
gaagaagact caacgtattt ctcaaatgtt tga                                 2853

SEQ ID NO: 154
MSDNPFNASL LDEDSNRERE ILDATAEALS KPSPSLEYCT LSVDEALEKL DTDKNGGLRS     60
SNEANNRRSL YGPNEITVED DESLFKKFLS NFIEDRMILL LIGSAVVSLF MGNIDDAVSI   120
TLAIFIVVTV GFVQEYRSEK SLEALNKLVP AECHLMRCGQ ESHVLASTLV PGDLVHFRIG   180
DRIPADIRII EAIDLSIDES NLTGENEPVH KTSQTIEKSS FNDQPNSIVP ISERSCIAYM   240
GTLVKEGHGK GIVVGTGTNT SFGAVFEMMN NIEKPKTPLQ LTMDKLGKDL SLVSFIVIGM   300
ICLVGIIQGR SWLEMFQISV SLAVAAIPEG LPIIVTVTLA LGVLRMAKRK AIVRRLPSVE   360
TLGSVNVICS DKTGTLTSNH MTVSKLWCLD SMSNKLNVLS LDKNKKTKNS NGNLKNYLTE   420
DVRETLTIGN LCNNASFSQE HAIFLGNPTD VALLEQLANF EMPDIRNTVQ KVQELPFNSK   480
RKLMATKILN PVDNKCTVYV KGAFERILEY STSYLKSKGK KTEKLTEAQK ATINECANSM   540
ASEGLRVFGF AKLTLSDSST PLTEDLIKDL TFTGLIGMND PPRPNVKFAI EQLLQGGVHI   600
IMITGDSENT AVNIAKQIGI PVIDPKLSVL SGDKLDEMSD DQLANVIDHV NIFARATPEH   660
KLNIVRALRK RGDVVAMTGD GVNDAPALKL SDIGVSMGRI GTDVAKEASD MVLTDDDFST   720
ILTAIEEGKG IFNNIQNFLT FQLSTSVAAL SLVALSTAFK LPNPLNAMQI LWINILMDGP   780
PAQSLGVEPV DHEVMKKPPR KRTDKILTHD VMKRLLTTAA CIIVGTVYIF VKEMAEDGKV   840
TARDTTMTFT CFVFFDMFNA LACRHNTKSI FEIGFFTNKM FNYAVGLSLL GQMCAIYIPF   900
FQSIFKTEKL GISDILLLLL ISSSVFIVDE LRKLWTRKKN EEDSTYFSNV             950

SEQ ID NO: 155
atgaatgaa aagaggtttc aagtggctct ggaagaacgc agagcaacaa caacaaaaaa    60
aataacaacg gaggcagtac aggaatctcg catgcgtctg gctcaccttt aacggacggc   120
aacggtggca atagcaacgg taatagtaga agtagaagca gaagtagaaa atctagtgga   180
actacaggtg gtttgctaaa aaagccgccg ctgcttgtga acaatgaagc ggtgcatgct   240
agcgtacccg acgcgtcgca cacttcctgt aacaatggca cgcttgaagt gagcataaat   300
aaccctgagc cacatgtggt agatgccgtg gcacgcacat tgataagaaa cccgagtaac   360
agcctacaat tgcaaggcgg agacattaca agagatctgt ataagtggac aaacgaccat   420
ccttcatcac catcgcagta tcagtaccca agtcaacctg cacttccac ctcaataccct   480
tcacaagcgc cctcattctc gaatcgtaaa aggtctatga gcttttctgc cgcttctata   540
gcatcttcct ctcaccttaa caacaactcg gaggcgaatg ggaatcctct agcggcaata   600
ggcctggcgc ccgcaccgat gacgcacgaa gaaatcaggg ctcctggtgg attcagaaga   660
tctttataa tacagaagcg caggaaacat aacgttgatg cgcccatacc gaattttttc   720
accaggaact ttattgaatt tttgaccttg tatggccact cgctggtga agattatcg    780
gaagaagagg aggaggagga agaaactgaa gaggaagccag aggaggaagc tttggaaacg   840
gaaagcaccc agctagtttc tcgtgaacac gggcgccatc ctcacaaatc atctcgacgta   900
aaggcggtgc tgctcttgtt aaagtcattt gttgggacag gtgtgctttt cctaccaaag   960
gctttccata acgttggttg gggattagc gcccctttgtc tactctcgtg tgccctcatt   1020
tcttatggat gtttcgtatc attgattacc accaaggaca aagtaggcgt agatgggtac   1080
ggtgacatgg gtcgtatact atatgggccc aaaatgaaat ttgccattct ttcgtctatc   1140
gccttgtcac aaatcgggtt ttctgctgca tacactgttt tcactgcaac taatttgcag   1200
gtcttttctg aaaatttctt ccatttgaaa ccgggcagca tcagtctagc cacctatatc   1260
tttgcacaag tactcatctt tgtcccacta tctttgacaa gaaacatagc caagtaagt   1320
gggaccgcgt taatagcaga tctatttatt ctactggat tggttatgt ttacgtttaa   1380
tccatttatt atattgctgt taatggtgtc gcatccgata caatgcttat gttcaataaa   1440
gcggactggt cgttgttcat cggtaccgcc atattcacct ttgaaggtat aggcctactt   1500
atccccattc aggagtcaat gaaacacccg aagcatttcc ggccatcgtt gtccgcggtg   1560
atgtgtatcg tggcagtgat tttcatatca tgtggtctct tatgctatgc cgcttttgga   1620
tctgacgtga aaactgttgt tttattgaat tttccgcagg acacttccta tactctcact   1680
gttcaattac tgtatgcatt agccatttt ttatccacgc cgttgcagct atttcccgcg   1740
atacgtattt tggaaaactg gacttttccc tcaaatgcat ctggtaaata aacccgaaa    1800
gtcaaatggt tgaaaaacta tttccgttgc gctattgtcg tcctgaccatc tatcctcgct   1860
tgggtaggcg ccaacgattt ggacaaattt gtatcactgg taggctcctt cgcgtgtatc   1920
ccattgatct acatataccc gccattgttg cactataagg cgtccatctt atctgtaacc   1980
tcgagagcca ggcttctttt agatttaatc gtcatagtat ttggagttgc tgtcatggcc   2040
tacacgtcat ggcagacgat taaaatgtgg agccagtaa                          2079

SEQ ID NO: 156
MNGKEVSSGS GRTQSNNNKK NNNGGSTGIS HASGSPLTDG NGGNSNGNSR SRSRSRKSSG    60
TTGGLLKKPP LLVNNEAVHA SVPDASHTSC NNGTLEVSIN NPEPHVVDAV ARHLIRNPSN   120
SLQLQGGDIT RDLYKWTNDH PSSPSQYQYP SQPALSTSIP SQAPSFSNRK RSMSFSAASI   180
```

TABLE 3-continued

Sequences disclosed herein.

```
ASSSHLNNNS EANGNPLAAI GLAPAPMTHE EIRAPGGFRR SFIIQKRRKH NVDAPIPNFF    240
TRNFIEFLTL YGHFAGEDLS EEEEEEEETE EEPEEEALET ESTQLVSREH GRHPHKSSTV    300
KAVLLLLKSF VGTGVLFLPK AFHNGGWGFS ALCLLSCALI SYGCFVSLIT TKDKVGVDGY    360
GDMGRILYGP KMKFAILSSI ALSQIGFSAA YTVFTATNLQ VFSENFFHLK PGSISLATYI    420
FAQVLIFVPL SLTRNIAKLS GTALIADLFI LLGLVYVYVY SIYYIAVNGV ASDTMLMFNK    480
ADWSLFIGTA IFTFEGIGLL IPIQESMKHP KHFRPSLSAV MCIVAVIFIS CGLLCYAAFG    540
SDVKTVVLLN FPQDTSYTLT VQLLYALAIL LSTPLQLFPA IRILENWTFP SNASGKYNPK    600
VKWLKNYFRC AIVVLTSILA WVGANDLDKF VSLVGSFACI PLIYIYPPLL HYKASILSGT    660
SRARLLLDLI VIVFGVAVMA YTSWQTIKMW SQ                                  692

SEQ ID NO: 157
atgagtaata cttcttcgta cgagaagaat aatccagata atctgaaaca caatggtatt     60
accatagatt ctgagtttct aactcaggag ccaataacca ttccctcaaa tggctccgct    120
gtttctattg acgaaacagg ttcagggtcc aaatggcaag actttaaaga ttctttcaaa    180
agggtaaaac ctattgaagt tgatcctaaa cttcagaag ctgaaaaagt ggctatcatc     240
actgcccaaa ctccattgaa gcaccacttg aagaatagac atttgcaaat gattgccatc    300
ggtggtgcca tcggtactgg tctgctggtt gggtcaggta ctgcactaag aacaggtggt    360
cccgcttcgc tactgattgg atgggggtct acaggtacca tgatttacgc tatggttatg    420
gctctggggtg agttggctgt tatcttccct atttcgggtg ggttcaccac gtacgctacc    480
agatttattg atgagtcctt tggttacgct aataatttca attatatgtt acaatggttg    540
gttgtgctac cattggaaat tgtctctgca tctattactg taaatttctg gggtacagat    600
ccaaagtata gagatgggtt tgttgcgttg ttttggcttg caattgttat catcaatatg    660
tttggtgtca aaggttatgg tgaagcagaa ttcgtctttt catttatcaa ggtcatcact    720
gttgttgggt tcatcatctt aggtatcatt ctaaactgtg gtggtggtcc aacaggtggt    780
tacattgggg gcaagtactg gcatgatcct ggtgcctttg ctggtgacac tccaggtgct    840
aaattcaaag gtgtttgttc tgtcttcgtc accgctgcct tttcttttgc cggttcagaa    900
ttggttggtc ttgctgccag tgaatccgta gagcctagaa agtccgttcc taaggctgct    960
aaacaagttt tctggagaat caccctattt tatattcgt cgctattaat gattggtctt   1020
ttagtcccat acaacgataa aagtttgatt ggtgcctcct ctgtggatgc tgctgcttca   1080
cccttcgtca ttgccattaa gactcacggt atcaaggggt tgccaagtgt tgtcaacgtc   1140
gttatcttga ttgccgtgtt atctgtcggt aactctgcca tttatgcatg ttccagaaca   1200
atggttgccc tagctgaaca gagatttctg ccagaaatct ttctctacgt tgaccgtaag   1260
ggtagaccat tggtgggaat tgctgtcaca tctgcattcg gtcttattgc gtttgttgcc   1320
gcctccaaaa aggaaggtga agttttcaac tggttactag ccttgtctgg gttgtcatct   1380
ctattcacat ggggtggtat ctgtatttgt cacattcgtt tcagaaaggc attggccgcc   1440
caaggaagag gcttggatga attgtctttc aagtctccta ccggtgtttg gggttcctac   1500
tgggggttat ttatggttat tattatgttc attgcccaat tctacgttgc tgtattcccc   1560
gtgggagatt ccaagtgc ggaaggtttc ttcgaagctt atctatcctt cccacttgtt    1620
atggttatgt acatcggaca caagatctat aagaggaatt ggaagctttt catcccagca   1680
gaaaagatgg acattgatac gggtagaaga gaagtcgatt tagatttgtt gaaacaagaa   1740
attgcagaag aaaaggcaat tatggccaca aagccaagat ggtatagaat ctggaatttc   1800
tggtgttaa                                                           1809

SEQ ID NO: 158
MSNTSSYEKN NPDNLKHNGI TIDSEFLTQE PITIPSNGSA VSIDETGSGS KWQDFKDSFK     60
RVKPIEVDPN LSEAEKVAII TAQTPLKHHL KNRHLQMIAI GGAIGTGLLV GSGTALRTGG    120
PASLLIGWGS TGTMIYAMVM ALGELAVIFP ISGGFTTYAT RFIDESFGYA NNFNYMLQWL    180
VVLPLEIVSA SITVNFWGTD PKYRDGFVAL FWLAIVIINM FGVKGYGEAE FVFSFIKVIT    240
VVGFIILGII LNCGGGPTGG YIGGKYWHDP GAFAGDTPGA KFKGVCSVFV TAAFSFAGSE    300
LVGLAASESV EPRKSVPKAA KQVFWRITLF YILSLLMIGL LVPYNDKSLI GASSVDAAAS    360
PFVIAIKTHG IKGLPSVVNV VILIAVLSVG NSAIYACSRT MVALAEQRFL PEIFSYVDRK    420
GRPLVGIAVT SAFGLIAFVA ASKKEGEVFN WLLALSGLSS LFTWGGICIC HIRFRKALAA    480
QGRGLDELSF KSPTGVWGSY WGLFMVIIMF IAQFYVAVFP VGDSPSAEGF FEAYLSFPLV    540
MVMYIGHKIY KRNWKLFIPA EKMDIDTGRR EVDLDLLKQE IAEEKAIMAT KPRWYRIWNF    600
WC                                                                   602

SEQ ID NO: 159
atggtgaacg ttggtccttc tcatgctgca gttgctgtgg atgctagcga agcccgcaaa     60
agaaatattt cagaagaagt attcgaactg agggataaga aagattctac agtggtaatt    120
gagggtgaag ccccggtaag aacttttacc agtagctcta gtaaccatga agagaggat     180
acgtatgttt ctaaaaggca ggtaatgaga gatatttcta taaatactt gaagttcatt    240
ggacctggat tgatggttag tgtggcttac atcgatcccg gtaattactc tactgccgtc    300
gatgcaggtg cctctaatca attttcccta cttttgtatca ttttgttatc aaactttatt    360
gccatatttt tgcaatgtct gtgtatcaag ttgggttccg ttacgggact agatctaagt    420
cgagcttgca gagagtattt accacgtgtg ctcaactgga cattgtattt ttttgcagaa    480
tgtgccgtta tagccaccga tatagctgaa gtgattggta cagcgattgc cttgaatatc    540
ctgatcaaag tgccccttcc agcgggcgtg gccattactg ttgtggatgt gttttttgatt    600
atgtttacat ataaacctgg tgcgtcatca attaggttca ttagaatatt tgaatgtttt    660
gttgcagtat tagttgttgg cgtatgcatt tgtttcgcaa tagaattggc ttatatccgt    720
aagagtacgt ccgttaaaca agtgttcaga ggatttgtgc catctgccca aatgtttgac    780
cacaatggta tttataccgc tatttccatc ttaggtgcta ctgttatgcc acattcgttg    840
ttttttgggtt ccgctttagt gcagccaagg cttttagatt atgacgttaa acacggtaat    900
tatactgttt ctgaagaaca agataaagtg aaaaaatcta aatccactga gactagattta    960
gaagaaaaat attttaatta tagacccacg aacgctgcta tcaaatattg catgaaatat   1020
tctatggtcg aattaagcat aactctcttc accctagcgc ttttcgtcaa ttgtgccatc   1080
ctagttgttg cgggctccac tctatataac tcaccagaag cagatgggc agatttgttt   1140
actattcatg aattattatc aagaaatctg gcacccgcag caggtacgat tttcatgctc   1200
gcacttttat taagtggtca atccgcaggt gtagtgtgta ctatgtcggg tcaaattgta   1260
```

TABLE 3-continued

Sequences disclosed herein.

```
agtgagggtc atattaattg gaagttgcag ccatggcaaa gaagattggc cactagatgt    1320
atttcgataa tcccttgttt ggtcatctct atctgtatcg gtagagaagc tttatcaaag    1380
gccttaaatg cttcccaagt tgttttatcc atagttctgc cattttttggt agcacccttta  1440
attttcttca catgtaaaaa atcaatcatg aaaaccgaaa ttaccgtcga ccatactgaa    1500
gaagatagcc ataaccatca aaataacaac gatagatctg caggtagcgt aatcgagcaa    1560
gatggttcta gtggcatgga gatagaaaat ggaaaagatg tcaaaatcgt ttatatggca    1620
aacaattgga ttatcactgt tattgctata attgtgtggc ttttcttatc tttactgaac    1680
gtttatgcca ttgttcaatt aggcatgtct catggtgata tcagttaa                1728

SEQ ID NO: 160
MVNVGPSHAA VAVDASEARK RNISEEVFEL RDKKDSTVVI EGEAPVRTFT SSSSNHERED     60
TYVSKRQVMR DIFAKYLKFI GPGLMVSVAY IDPGNYSTAV DAGASNQFSL LCIILLSNFI    120
AIFLQCLCIK LGSVTGLDLS RACREYLPRW LNWTLYFFAE CAVIATDIAE VIGTAIALNI    180
LIKVPLPAGV AITVVDVFLI MFTYKPGASS IRFIRIFECF VAVLVVGVCI CFAIELAYIP    240
KSTSVKQVFR GFVPSAQMFD HNGIYTAISI LGATVMPHSL FLGSALVQPR LLDYDVKHGN    300
YTVSEEQDKV KKSKSTEEIM EEKYFNYRPT NAAIKYCMKY SMVELSITLF TLALFVNCAI    360
LVVAGSTLYN SPEADGADLF TIHELLSRNL APAAGTIFML ALLLSGQSAG VVCTMSGQIV    420
SEGHINWKLQ PWQRRLATRC ISIIPCLVIS ICIGREALSK ALNASQVVLS IVLPFLVAPL    480
IFFTCKKSIM KTEITVDHTE EDSHNHQNNN DRSAGSVIEQ DGSSGMEIEN GKDVKIVYMA    540
NNWIITVIAI IVWLFLSLLN VYAIVQLGMS HGDIS                              575

SEQ ID NO: 161
atggcagaag tactgaccgt cctcgagcag ccgaactcaa ttaaagattt tctcaagcag     60
gattcaaata ttgcgtttct agctggtgga gtagctggcg cggtttcccg aaccgttgtt    120
tcacctttttg agagagttaa aatactgctg caagttcaaa gttcaaccac ttcttataac   180
cgaggtatct ttagctctat acggcaggtt taccatgagg agggaaccaa aggtttattc    240
agaggaaatg gtttgaactg cataagaatt tttccctata gtgcagtcca gtttgtagta    300
tacgaagctt gtaagaaaaa gttattccat gtaaatggca ataatggaca agaacaacta    360
acgaacaccc aaagactatt cagtggtgca ttgtgtggtg gttgtagtgt ggtggctact    420
tacccgttgg acttgatcaa aacaagacta tcgattcaga cagcaaattt gagcagttta    480
aaccgctcaa aggcaaaaag tatatcaaag cctccgggga tctggcaatt actaagcgaa    540
acttacagac tcgaaggcgg tctcagggga ttatataggg gtgtatggcc aacgagtcgtt   600
ggtgttgttc catatgtagc actaaacttt gcagttttacg aacaattgag agaattcggt    660
gtcaattcct ccgatgctca gccttcctgg aaaagtaacc tctataaatt aacaattggc    720
gccataagtg gagggggttgc gcaaacaatc acttatccct ttgatctgct aagaagaaga   780
tttcaagttc tcgcaatggg cggaaatgaa ctgggattta gatacacgag tgtctgggat    840
gcgctcgtga caatcggcag agcagaaggc gttagcggtt actacaaagg cttagctgca    900
aaccttttta aagttgttcc ttcaactgca gtgagttggc tagtttacga agttgtatgt    960
gattctgtaa gaaattggtg a                                              981

SEQ ID NO: 162
MAEVLTVLEQ PNSIKDFLKQ DSNIAFLAGG VGAVSRTVV SPFERVKILL QVQSSTTSYN     60
RGIFSSIRQV YHEEGTKGLF RGNGLNCIRI FPYSAVQFVV YEACKKKLFH VNGNNGQEQL    120
TNTQRLFSGA LCGGCSVVAT YPLDLIKTRL SIQTANLSSL NRSKAKSISK PPGIWQLLSE    180
TYRLEGGLRG LYRGVWPTSL GVVPYVALNF AVYEQLREFG VNSSDAQPSW KSNLYKLTIG    240
AISGGVAQTI TYPFDLLRRR FQVLAMGGNE LGFRYTSVWD ALVTIGRAEG VSGYYKGLAA    300
NLFKVVPSTA VSWLVYEVVC DSVRNW                                        326

SEQ ID NO: 163
atgttttcac ttagttcgct atctagcagc ggtgggcatt cagagcagaa ggaaagagag     60
agaataagtt attttgatat tagaataaac tccccgtaca aggacataat tttgatccaa    120
gggtcaccgt tggaactgtc gtctataccct ttatcaggaa acttagtgat ttcagtgaaa   180
aatgagatcg tagtgaagaa aatttcgctg agattggtag gaagattcaa attggagttt    240
ttgcaagttg gccgatataa gaagaatagc agtagtttgg caagtctagt taaggaaaag    300
cgtaagattt tcgaatgcta ttgggacaac ttattgtttc cttcaaaagg ggatgtttta    360
gtcggtgggg aaaatgcgga aaatcaacat aacagtagta gcggtcgcag tacaagcaac    420
caagatatgg acaccagcgg caacgcaata tttctaagca agagatcact ttcgagccct    480
gttttcaaca aaataattcg aagaaagacc cattcttccc acagaaaaat actagagcta    540
ccagaaaatg gtgttacagg aaccccctttc gagggtttaa gagaaacgc ccgtagtaga    600
agcagtagta gtaacaccct caataacaat agccatagtt atagtaacag agcgggtcat    660
ggaagttcgt acttattcct aatgaaaaga ggcaactacg aactacccct caataacaatg   720
ctccccccag aagtgtgcga aacaatcgag ggactacaaa gtggtagcat actgtattcc    780
tttgaagcca ttagatggg acgtcagtta tgggatactg atctgagcgt tcatacttct    840
cctcacggtc caatcggtag cacaagtacg agcggcaatg gtatgagaac gaagaataaa    900
attatcatca aaaagttcaa gtatctcaga atccttcgta cattatcgat ggacaatctt    960
gccatgcaag aagaaattag cgtgggtaat acttggcgtg acaagttgca atacgaaacg   1020
tccatcccga gtagggctgt tcctattggt agcacaaccc ccgtgaagat taagattttc   1080
cccttcgaaa agaacattcg tttgataggg atagaaatgg cgctaatcca atattacgca   1140
atgaaggaca gcagcgcaca aatttatgat gatgaaatag ccgtcatgaa aattactcat   1200
ctagcggact tcggcccgct gacggacaaa cttgacgtcg attgtccctt tacaattcca   1260
gataacctca aacaaataac tcaagactgc tgtctgcaag acaacctaat ccgtgtcatg   1320
cacaaattgc aggtacgtat tcttttacaa cgtcaagtgg atggcgaata caagaacctg   1380
gagatcaagg cgcaattacc tatgttatta tttatttcgc cgcatctgcc tatgaaaggc   1440
cgtcagtgt tgtttgataa acacgatggc aagatccact tccgcctggg cgaattagta   1500
cccctttttt taaccactta ccccgcgcag ggtctgactc caggcgttga actgaactcc   1560
actacaacgg cgcacctcgc gctgccacaa ccgcaccga attatcacga gagcaccaac   1620
```

TABLE 3-continued

Sequences disclosed herein.

```
gatcatctca tgccggcgct acagccgctc ggcgccgatt cggtggtact gacagtgccg   1680
tcatacgagc aggcgcaggc gcaggcatcg gcatcgtctt acgtgacagg gtccgtaccc   1740
gcttactgcg acgatgactg a                                             1761
```

SEQ ID NO: 164

```
MFSLSSLSSS GGHSEQKERE RISYFDIRIN SPYKDIILIQ GSPLELSSIP LSGNLVISVK    60
NEIVVKKISL RLVGRFKLEF LQVGRYKKNS SSLASLVKEK RKIFECYWDN LLVSSKGDVL   120
VGGENAENQH NSSSGRSTSN QDMDTSGNAI FLSKRSLSSP VFNKIIRRKT HSSHRKILEL   180
PENGVTGTPF EGLRENARSR SSSSNTLNNN SHSYSNRDGS GSSYLFLMKR GNYELPFNTM   240
LPPEVCETIE GLQSGSILYS FEAIIDGRQL WDTDLSVHTS PHGPIGSTST SGNGMRTKNK   300
IIIKKFKYLR ILRTLSMDNL AMQEEISVGN TWRDKLQYET SIPSRAVPIG STTPVKIKIF   360
PFEKNIRLDR IEMALIQYYA MKDSSAQIYD DEIAVMKITH LADFGPLTDK LDVDCPFTIP   420
DNLKQITQDC CLQDNLIRVM HKLQVRILLQ RQVDGEYKNL EIKAQLPMLL FISPHLPMKG   480
RLVLFDKHDG KIHFRPGELV PLFLTTYPAQ GLTPGVELNS TTTAHLALPQ PPPNYHESTN   540
DHLMPALQPL GADSVVLTVP SYEQAQAQAS ASSYVTGSVP AYCDDD                  586
```

SEQ ID NO: 165

```
atgtcgttac tgagactgtg gaacaaagaa tcaagggcac catcaaaaat aaagagtcat    60
ggtattgttg gcagttacgg caacagcatg ctggcccata acaacgtgaa gcaatttcgt   120
atagacatag acgaaccgca tagagtatgg aaaccgaatg aaagcataac cggagaagcg   180
gtcattgaca taaagagaga cataactaac gtagcgatca aattatcgct agtatgtgag   240
gttcgcgtga aaacgggaa cagtccaacc tccaagaata agagaattga aaaaccttta   300
gagaagtcga cgtttcttta tggacaggac tacgtaaaga cagcttttc ggctaaggaa   360
aagaaaccgc atgttgacaa aaccaccatt ctcaatggtt taagcaaggg ggaacacagg   420
tttcccttta ggatacgaat accacgaggc agaggaatgt tgagctctat aaagttcgaa   480
aggggctcga taacatactt cctctcttgc acttagaat ccctcaacaa catcaacgga   540
ttaaaaaaac cggaagcaag atgcgaacgt gagtttgcag tcatagttcc gctggacgtc   600
tcgaggctgc ccaagccgaa aactaagaca gtggttttac aatcagcatc tatggtccaa   660
aacaaaaaga acaaatctac agaggacgaa tcctcatcgt atacacaatt aactcaaaag   720
tctactactt ctaattcttc tagcagttca gtaaactcca agacgtcccc cttaccaaat   780
aaaacggtga ctatatccgt agacataccg caggctggat tcatgattgg tgaaattatc   840
cctatagacg ttaagattga ccactataag ccttttcagg cccctgcggg tctccaccacc   900
actttggtga ggatatgtag ggtgggcggt gcaggcaaag atgatcctat ggagactttc   960
agaaaagata tatgtcagag tatctctcct atatatatta accctgaaac gttgcagttt  1020
caatctagag ttttatctgaa agtgcccctt gatgcatttt cgaccttac tactgtggga  1080
aaattttct ccttccaata ctatatcgag gttatggtta actatcaaa aaaaacgtg   1140
gtttacacag aatctaatag aataatagga actcctattg gagaacaaaa tggcttgggc  1200
gtagagaata atatcaaccg tatccaaagg aaaatgctac gtatggtcaa tccagaaacg  1260
ttggagaacg attctgaggg ttatgaatcc agtatatttt tcaaagatat ggtaaatgtg  1320
gaaaagctaa agagactgag gaatgtaact ggtatgtcca tgaaaccgt cataggaacg  1380
acgagatccg aacagcagca atctgatgca agcatcccat cccaatcctc aatcacggct  1440
cctcaaaatt ctccatcgaa tttaagagat tggttggccc cattaaatgc atatgatagt  1500
gacgatgttc cagttccaaa gtattcgcca aatgataaag tcagtgtacc gtcggaagac  1560
aaacaagaac ttgaacaaaa aagactacaa cagttagaaa gcgatcctcc cccttgtgat  1620
gactattaa                                                         1629
```

SEQ ID NO: 166

```
MSLLRLWNKE SRAPSKIKSH GIVGSYGNSM LAHNNVKQFR IDIDEPHRVW KPNESITGEA    60
VIDIKRDITN VAIKLSLVCE VRVKTGNSPT SKNKRIEKTL EKSTFLYGQD YVKTAFSAKE   120
KKPHVDKTTI LNGLSKGEHR FPFRIRIPRG RGMLSSIKFE RGSITYFLSC TLESLNNING   180
LKKPEARCER EFAVIVPLDV SRLPKPKTKT VVLQSASMVQ NKKNKSTEDE SSSYTQLTQK   240
STTSNSSSSS VNSKTSPLPN KTVTISVDIP QAGFMIGEII PIDVKIDHYK PFYAPAGLTT   300
TLVRICRVGG AGKDDPMETF RKDICQSISP IYINPETLQF QSRVYLKVPL DAFSTLTTVG   360
KFFSFQYYIE VMVNLSKKNV VYTESNRIIG TPIGEQNGLG VENNINRIQR KMLRMVNPET   420
LENDSEGYES SIFFKDMVNV EKLKRLRNVT GMSIETVIGT TRSEQQQSDA SIPSQSSITA   480
PQNSPSNLRD WLAPLNAYDS DDVPVPKYSP NDKVSVPSED KQELEQKRLQ QLESDPPPCD   540
DY                                                                  542
```

SEQ ID NO: 167

```
atgccagagc aagaactact tatagggcaa gaaatgaata cacttcatgc aggttcatct    60
actgatggca taaatgtcgg aaacgcagga cgaactagag acacacaaac tggcgtagaa   120
ggggaaacgg aaatagggtc tgacgaggaa gatagcatag aggacgaggg aagcagcagt   180
ggaggaaata gtacgacaga aagactagta ccacaccagc tgagggaaca agcagccaga   240
catataggaa aaataggaag acattttaat attcttgata gacttttaa gaaacgtaca   300
caacagtctt cggatataca acaaggtgcc atgtttgatg gtgtctttag caatttaagc   360
gcaaaaccag ataccacaga gactgaaggt aataacgaac agagcatacc acctacatac   420
gacgaagctg ctgctgatat ggccccctcg tattatggaa tggatttgaa caattcagat   480
atctactacg acgaaaatatg cattgagggg cttcctgtag gaaatatagc aaatttatta   540
tggaatatca tcgtaagcac gagttttcag ttcattggat ttttaataac ctacatttta   600
cacacatctc acgcagcaaa gcaaggttca aggtttggat tagggttaac gttcattgga   660
tatgttatt caatgattcc caatgatgtt acttcaaaag tcggcaaaaa taaagctta    720
aatagaatgg aattaggga tccaaatgaa ttcgatgatg ttcgtctaaa ttcacaatca   780
acgacacaag ataaatttga atcacatttg aatcacggtc tggatgaaga aaaacaaaac   840
ataccatggt tggctgtttt tgtggcattt cttgggctat ttatcaccct gaagagtata   900
tacgactaca ttcaagtcaa aaaattggaa aagaaatacc tcaaccaaag tcaaaatcaa   960
gcataa                                                             966
```

TABLE 3-continued

Sequences disclosed herein.

```
SEQ ID NO: 168
MPEQELLIGQ EMNTLHAGSS TDGINVGNAG RTRDTQTGVE GETEIGSDEE DSIEDEGSSS     60
GGNSTTERLV PHQLREQAAR HIGKIGRHFN ILDRLFKKRT QQSSDIQQGA MFDGVFSNLS    120
AKPDTTETEG NNEQDIPPTY DEAAADMAPS YYGMDLNNSD IYYDEICIEG LPVGNIANLL    180
WNIIVSTSFQ FIGFLITYIL HTSHAAKQGS RFGLGLTFIG YGYSMIPNDV TSKVGKNKSL    240
NRMELEDPNE FDDVRLNSQS TTQDKFESHL NHGLDEEKQN IPWLAVFVAF LGLFITLKSI    300
YDYIQVKKLE KKYLNQSQNQ A                                              321

SEQ ID NO: 169
atgtcattca agtttctgat agaatcgctg cttctcggtt cgataagcgg acaaatacgg     60
tgtggtagat cttcggtgat cccccgtggc gatgtatctt atgggggaga cgatactgac    120
gaacttaaca tggatataat gttgtttgcg tttgaaccct taatcgtggt ctacatcgtc    180
atctgtatcg tttattttt tacaaaacag atagctacgc ggcttataac tgcatattat    240
aatgagcatg gccctggcca aagaaatatct ttattcgacg attatgacga aaataatgca    300
cacgttcata gcagaagatt aatgaaaaac atgagtttaa ggtggcccaa caatcttgac    360
gatgctgatg aagtaagaga taagctggca cagttgtcac ctgaagagca gttttattat    420
aagcaaggtg aggagtatat caagcagaac ccaccatttc tgcttaacca gggactttta    480
caacagtccg aagatagcaa tccagacacc acccgtgaag accctattat gaacgagcaa    540
acaaggcaat atattcaaga agaggggggct tatgcatggg agtttagccc aaatcctgat    600
atgccaaacc atactgtcat agtggaaaat aaaacagagg tttcttttct aaattataat    660
tatgatgctt ctatatccac aaatctaccc attccgtgta taaataaagt atattattgt    720
gaattcaaga tatttgaaac ggatggccca ctaaacagtg atgaaaatgt atcgaaaggt    780
gtcatctcat ttggtctttc cacacagcct tatccatatt tcaggttacc gggaagacac    840
caccattcga tagcatacga ttctaacggc gccagaagat ttaatgactc cttcaaacta    900
aatgagcaat taagaacgtt atttccacag tgtgaaaagg gagacattgt tggcattggc    960
tataggtcac gtagtggaac agtattttc accaggaacg gaaaaaaact aaatgaaaaa   1020
tctgttggtg gtcatatccg cggctggaaa ttccaatacc tatacccgat cattggctcc   1080
aacgtacctt gtcaaattca tgtgaatttc ggcacttatg gctttgttta tagaagca    1140
aacgttaaaa aatgggggata cgcaaagtca acggcatta aattacctcc tccttcttac   1200
gaagactacg gtaaagatac cctattagaa agcggtggtg aagacaatga tttcgacgaa   1260
gattttcag acggtgatag cgacaatatt gcggctggta gtactacaaa tctcaatgat   1320
gatataatta taagaaacgg tgaaatatta ccgccaccac ctggatttga attcactatg   1380
tcccctccca ctgaaagaa gatcatcaat gaggaaatta atctagattc cttacctatg   1440
ctaccaccaa gttactcgga cgatgaacat cattcgaaaa atgataaatc agcaataagc   1500
ggacgaatta ttggaacgag cagaaattta attactgatg aagcatcttt cgatagtgtt   1560
gataatgata acgaagatga aaatgatcac gagagagatc ccgaacaatt ttcagaattt   1620
gatgattacg aaagcaggat gcatggcata taa                                1653

SEQ ID NO: 170
MSFKFLIESL LLGSISGQIR CGRSSVIPRG DVSYGGDDTD ELNMDIMLFA FGTLIVVYIV     60
ICIVYFFTKQ IATRLITAYY NEHGPGQRIS LFSDYDENNA HVHSRRLMEN MSLRWPNNLD    120
DADEVRDKLA QLSPEEQFYY KQGEEYIKQN PPFLLNQGLL QQSEDSNPDT TREDPIMNEQ    180
TRQYIQEEGA YAWEFSPNPD MPNHTVIVEN KTEVSFLNYN YDASISTNLP IPCINKVYYC    240
EFKIFETDGP LNSDENVSKG VISFGLSTQP YPYFRLPGRH HHSIAYDSNG ARRFNDSFKL    300
NEQLRTLFPQ CEKGDIVGIG YRSRSGTVFF TRNGKKLNEK SVGGHIRGWK FQYLYPIIGS    360
NVPCQIHVNF GTYGFVYIEA NVKKWGYAKS NGIKLPPPSY EDYGKDTLLE SGGEDNDFDE    420
DFSDGDSDNI AAGSTTNLND DIIIRNGEIL PPPPGFEFTM SPPTGKKIIN EEINLDSLPM    480
LPPSYSDDEH HSKNDKSAIS GRIIGTSRNL ITDEASFDSV DNDNEDENDH ERDPEQFSEF    540
DDYESRMHGI                                                           550

SEQ ID NO: 171
atgtatgtca ctttaatga ggctttggat agttctttg gtaatctaga gagtccgaat     60
catgacttca aagtaggtga ccctaacatg gtaccaactc cccctatgga ttcagattct    120
gcagcaatta gtttggcttt cttaataagt ctttctatta cgtttgcaat attaatgctc    180
atcttggtag taatagcggc atatgtcacc ttttgtggtg atgatgaatc agaatacgac    240
gaagagaacg ccttaggtac acgaaacttca ggaactctgc actctttgtt tggtaaaaaa    300
catagtggca tcttgttgga ttcgagtttt gcatccctgc gcgggtttga tgatgagatc    360
gttcttcagg aaagaaact tgaagaatta ccaaagatgt cagcgtacga ggttgagttg    420
tatataagag cgaaagagtt tcaaatgatg agcccgccaa tggtgaagga ctttggcacg    480
tatttggaca gtgacgacca gcagtttatt aaggatcgtg gcattcaaag ctatttttg    540
ctaccaagca ttaatgataa tagacgaa atgggaaact ttctacccag tttttattgtc    600
caggataaac tagatattca atttttcaaag ttcaataaga gctcatccac tgtaatgaac    660
tatccctac ctcacaatag gaaggacgca gtgtatttcg aagttaaaat ttttcagacat    720
attcaaaagt ccaatagtat attcagtata ggtttgacta ctgtaccata tccttattc    780
agggtaccgg gcatgccaa atactccatt gcatacgaat ccacaggtaa actgaggata    840
aataaccct tcactgccag cacattatta ccaaaattgg aagaaggtga cacgtaggaa    900
ttcggttaca gatataaaac aggtacaatc ttcattacac ataatgggaa aaaattaatg    960
gatgtaacac aaaatattgg cattgatctt ttcattggaa ttggcgcgtt taatgccgca   1020
tatacaagaa catatacgag ggatggtctaa ttggaaagacc cggataatgt tagcttccgt   1080
gaagctctct ctgaaggcaa agatattgaa gtcgccaaag atcttcaaag agttcacgat   1140
ccacatgatg aaagtgatga atgacgtca gatgaggttg aattacatgt taatttggc    1200
caagttgggt tcgtcttat agaagcaat tgaaaaat atgcgtttg gagtgtttat   1260
ggccaaattg gaattcctcc tgcgtataat ggaaccgaga tcaagaagga tactattttta   1320
cagaaaggag aagaattgcc accaagatat gctgacactg taatttcttt ggtagtatg    1380
aaggtaaaag aagggtcatc ctctaggata acggcgcaaa ctagtaagcc cctgtggtct   1440
gttgggacgt atgaaagaat ctcttctaac tttgacagag aaaataatgt taccacgac    1500
agtcttgaaa ccgacgataa caacaccgat aacaatgtta ataacaacga tgagaacgct   1560
```

TABLE 3-continued

Sequences disclosed herein.

```
ggttgcaatg aaaattcgcc attattggaa gatgatggca ataaaagacc ggaaaattca    1620
aatacccccc gtgaagtatc agatggagct atcaataaga accctagaaa taaatctact    1680
aaaaaacgtc aaagaaacag aggcaaatct tctaaaaaga agaacagatc gagaaaataa    1740

SEQ ID NO: 172
MYVTFNEALD SSFGNLESPN HDFKVGDPNM VPTPPMDSDS AAISLAFLIS LSITFAILML     60
ILVVIAAYVT FCGDDESEYD EENALGTRTS GTLHSLFGKK HSGILLDSSF ASPGGFDDEI    120
VLQERELEEL PKMSAYEVEL YIRAKEFQMM SPPMVKDFGT YLDSDDQQFI KDRGIQSYFL    180
LPSINDNIDE YGNFLPSFIV QDKLDIQFSK FNKSSSTVMN YPLPHNRKDA VYFEVKIFRH    240
IQKSNSIFSI GLTTVPYPYF RVPGMAKYSI AYESTGKLRI NNPFTASTLL PKLEEGDTVG    300
FGYRYKTGTI FITHNGKKLM DVTQNIGIDL FIGIGAFNAA YTRTYTRDGL LEDPDNVSFR    360
EALSEGKDIE VAKDLQRVHD PHDESDEMTS DEVELHVNLG QVGFVFIEAN VKKYAFGSVY    420
GQIGIPPAYN GTEIKKDTIL QKGEELPPRY ADTDNFFGSM KVKEGSSSRI TAQTSKPLWS    480
VGTYERISSN FDRENNVYHD SLETDDNNTD NNVNNNDENA GCNENSPLLE DDGNKRPENS    540
NTPREVSDGA INKNPRNKST KKRQRNRGKS SKKKNRSRK                          579

SEQ ID NO: 173
atggtgaata ctaggggcta cactactctt ccgaatgttg aagaaccagc aaataactca     60
caagatgagc taaactcgca ggactttgag caagctaatg gaatgccatc agaacccccg    120
gtatatgtgg aagagatggg gatggaagaa ccgcaggctc cggaagcctt tagtgagaaa    180
gtccagcgat ttcgtatgtg ttttgaaaat aacgtggtga ttccagtaaa gaaaaatgta    240
gtggatccgc tagcacaaat gatttccctg gcctctgaga aattcgattt gttcttaagt    300
aaaataggta atgttatggt aatgaggaga atattttaca tcatgatgat gtctatcatt    360
gcagcgttga ttattgcgag tgataggtta ccgaataaga aagctcgagg ttcaaatgga    420
tcattctcgg accatgatct ccttttacag tatgctcgga aatcgataga cctttcaaag    480
atagaaagag atttagagta tattagtagt atgcccacag tgtcaggaac aagtggtgat    540
gccgctatta gacattatat taaagagtcg ttcgacaaaa atggtataag gctagctggg    600
gaagaggagt tcatggcgta ttcgaattac ccaggaaatg tctcacttcg tgtatattca    660
aaggatgata cagaagggtt tgatattccc ttaaatgagg agaactttaa cccaatgagc    720
cataatggtc aattgaacaa cataccggtg atttatgcta ataaagcatc gttggacgat    780
atggcttcta tgcaagatca agggctttta aacggtgact ttatttttact agtgcattac    840
ggagattatg ttttccaaca aatgttgact gctcaagaat atggtgcgaa agcaattatc    900
tttatttctg agcctttatca agacaacaaa gacgtgatac aaatgaagtc agttgcgttg    960
ccgcagtatg gtactggtga tgcacttacg cctgaatggg aaggatcaat aagagatcct   1020
atcgatgcta cggaagccaa gtgcctaccc aaaattccat ccataccgat atctgccaat   1080
caaggagata aaatactagc tatattatca gacactggtg taaagttttc taataattta   1140
ttcagtgggt cgcttaacga ttgtcgactt gacctactag tgcaaacagc aattagggaa   1200
cgccacccgg ttcacgatat agttggtaaa attgaaggat cggaacaagc gggcagggca   1260
attgttattg ctgcaccgag gaactctgct agttatggca ctatgtatcc ttcttttgga   1320
accgtcgttt tgctgtctct gatccaatta tatcaagaaa tggtttacaa atttgactgg   1380
aagcctctaa gaaatatata tttcatttcc tttgggggct ctgaatttaa tgaagcggga   1440
gccacggagc tgatggaaaa gagaacagag gcattgaaga gtgaaatata caccattatc   1500
gacgtcggcc aaatcggtat atgggatgat agtaacaatt tagagataca atgtcatccg   1560
ctactagtag atcttttttca aaaaaacatg acaagccgta aatttaacgt taaagtggat   1620
aatgttcacc agttcggcga ctggacgccg tatctagcgc aagggattcc agttgcgatc   1680
atttcatctc caggagtcat gaatagaaaa catccgatct acacagtaga agacaaattc   1740
gatttcatca agataaaact aagagacaaa aagaagggag aggtacttttc tgagataatg   1800
ctatatcttg tcgaaaaatc actcgagctc attgacgatc cattcatccc attcagcata   1860
tcgaactacg tagatttcct ttcaactacg ttaaaagacc tccaaaaaga aatgtcctgat   1920
acggtaaact ttgacgaagt cttttttgggc acaacattgt gggaaaacac taaactgcag   1980
ttcgaaaaat ggaaaagcga atggacagag cttatgtatg gagccggtac atatatagaa   2040
cccactatca ttgccattaa tcgttggtca tggaactacc tactttccct aatagccgtt   2100
acccaatgtt tggaggaagg gttaatggat agaacctttt acaagaacgt tatcttcggg   2160
ccaaaactct gggtcgacaa aggtgaccca cttcgttcat ggacgttccc tgaaatcagg   2220
gacactattg caatcaagga ctggagctct gtgcaggttc aagctaacac actcggcaca   2280
attttacaaa atacagcacg ctattttctt gagaataaaa accttcatgg aataaacacg   2340
aacgaatttt ag                                                       2352

SEQ ID NO: 174
MVNTRGYTTL PNVEEPANNS QDELNSQDFE QAIGMPSEPP VYVEEMGMEE PQAPEAFSEK     60
VQRFRMCFEN NVVIPVKKNV VDPLAQMISL ASEKFDLFLS KIGNVMVMRR IFYIMMMSII    120
AALIIASDRL PNGKARGSNG SFSDHDLLLQ YARKSIDLSK IERDLEYISS MPHMSGTSGD    180
AAIRHYIKES FDKNGIRLAG EEEFMAYSNY PGNVSLRVYS KDDTEGFDIP LNEENFNPMS    240
HNGQLNNIPV IYANKASLDD MASMQDQGLL NGDFILLVHY GDYVFQQMLT AQEYGAKAII    300
FISEPYQDNK DVIQMKSVAL PQYGTGDALT PEWEGSIRDP IDATEAKCLP KIPSIPISAN    360
QGDKILAILS DTGVKFSNNL FSGSLNDCRL DLLVQTAIRE RHPVHDIVGK IEGSEQAGRA    420
IVIAAPRNSA SYGTMYPSFG TVVLLSLIQL YQEMVYKFDW KPLRNIYFIS FGGSEFNEAG    480
ATELMEKRTE ALKSEIYTII DVGQIGIWDD SNNLEIQCHP LLVDLFQKNM TSRKFNVKVD    540
NVHQFGDWTP YLAQGIPVAI ISSPGVMNRE HPIYTVEDKF DFIKDKLRDK KKGEVLSEIM    600
LYLVEKSLEL IDDPFIPFSI SNYVDFLSTT LKDLQKECPD TVNFDEVFLG TTLWENTKLQ    660
FEKWKSEWTE LMYGAGTYIE PTIIAINRWS WNYLLSLIGV TQCLEEGLMD RTFYKNVIFG    720
PKLWVDKGDP LRSWTFPEIR DTIAIKDWSS VQVQANTLGT ILQNTARYFL ENKNLHGINT    780
NEF                                                                 783

SEQ ID NO: 175
atgaggagca gttatcaacc agtgtcaact acaaactttg aacatgaaaa tgctatacct     60
actgcgtcgt cgtcccataa tctgttgatg agccagcgtt ttgatgattc tcctcctagt    120
tctaacgaca acagtataga aactaatata acgcctccac ctgaaccacc ttcttatgaa    180
```

TABLE 3-continued

Sequences disclosed herein.

```
tttgatatag aggaccctca cgatgatctt cacaaaagaa cacatctaca gagggtttca    240
attgggtttc aggaaaaaat tttggaaccc ttaatggaaa acatcattca tccactctta    300
caaatatcaa aattcgttcc agacaaagct gactattact taagtaaaat cggaaatccc    360
tttatacttc gaaggttctt ttacatcatt ttcatgtcat ttattgcata ttatgtcttg    420
tcaagtggct acttattcaa cgaaaaggca tcaggatcta aagggatgtt ttctcaacac    480
gatatacttt ttgaatatgc caaaaaatcc gtggatttgg caaagtttga gagagatttg    540
gaatatatta gtagcatgcc tcatgaatcc ggaacgaagg gtgatgcagc tatttatcga    600
tacattcagg aatctttga caacaatggg ttgaaattgg ttaaagaaat gggatactca    660
gtttattcta attatccagg caatgtatca atttcatatt atgataacaa gaatgaaaag    720
catgatctag aactttctaa agaaattttc aatccgttga gttctaacgg gaaattatcc    780
aaagtgagct tgatttatgg aggcaaaggt acaacatcgt atttacaaca tttaaaagat    840
tcgaaaacga tagaagatgg gaaggactat gtgcttttac tgcaaatatg taaattagtg    900
agtcagcaag tactaattgc tgagaaattc ggagctaaag ctgtaatctt catatctgag    960
ccatatggtg agaatataga cgttgttcaa tctaagcctg taggattgcc ccaatattcg   1020
actggtgatg catcaggatt gaattgggat ggttctccta gaagaaaaa ggatcataaa   1080
ttttggcgtc aaactcatat tccaactatc ccaatctcca cgagacaagg aaaagagcta   1140
ctatcgcgtt tatcttcagg aggagtaacg gttgatgatg gtaatagtga tcgtagtaac   1200
agtgggaaaa tgggagacgt attgatcgat gtagatctgc aaactaatgt tagggaaaag   1260
catttttattc ctaatattgt tggtaaaatt gaagggagag aacaatcaga caaagctata   1320
ataattgctc catcgagaaa ttccatcaat tttggaacta cttatcccaa ttttggtaca   1380
gctgcattat tatctatagt tcaattattc caagaggtga aatataagtt tggttggaaa   1440
cctttgagaa atatctattt catctcattc ggtggtaccg aatttaatta tgctggatct   1500
tcggagctgg ttgagcaaag gctaacgcca ttaaaagacg aaatttattc tttgattgat   1560
attagtcaac tgggtatacc ctttgccgaa aaatatgaga acggtaaaac tagaggagaa   1620
ttaagcattg agacacatcc cttattgaag aagttttca ataagaaacgc gcatggaaac   1680
tttgatatat ctgtggataa tgtacagcac tatggtgact ggactccatt tctggcaaat   1740
ggaattcctg tatctgtaat atcttctgat tctacggaca accgtgacac cccaactgaa   1800
acatctgagg ataaatttga acgtgttgag aagattctgg aagacgaaca gaaccaacaa   1860
tctgtcaagg attgctagt atatctttta catattagta tggaattgat tgatgacccg   1920
ctacttcatt ttgacataat aagctatgtt gaagatatcg atgaaagatt gcaaggtta   1980
gagcaagcat accctgaaaa actaaacttc acatcaataa tcaaggttt gttatttgg   2040
aagaaaatcg gtagcgaatg ggcgtcatgg actcaaggtt gggagaacat agtatggtcg   2100
catggggatg gtatagagcc ctccttactt tcaattaata ggtggacatg gaataaaaaa   2160
ttgactaata ttggtagaag aacatgctct ccggcgggtc tacctaatag atcatttat    2220
aagaacgttt tgttcggacc aacattgata caggaggata aatctaaaaa tggtggaaat   2280
gtagatttct ggacatttcc aggagtgatg gatgcgattt acgatgatga ctggaagagg   2340
gctcaagaac aaattgacct tattggcaaa gtactccatc agtctgctgc attgtttgtc   2400
gaagagacta atgacatcgg gtataaataa                                     2430

SEQ ID NO: 176
MRSSYQPVST TNFEHENAIP TASSSHNLLM SQRFDDSPPS SNDNSIETNI TPPPEPPSYE     60
FDIEDPHDDL HKRTHLQRVS IGFQEKILEP LMENIIHPLL QISKFVPDKA DYYLSKIGNP    120
FILRRFFYII FMSFIAYYVL SSGYLFNEKA SGSKGMFSQH DILFEYAKKS VDLAKFERDL    180
EYISSMPHGS GTKGDAAIYR YIQESFDNNG LKLVKEMGYS VYSNYPGNVS ISYYDNKNEK    240
HDLELSKENF NPLSSNGKLS KVSLIYGGKG TTYDLQHLKD SKTIEDGKDY VLLLQYDKLV    300
SQQVLIAEKF GAKAVIFISE PYGENIDVVQ SKPVGLPQYS TGDASGLNWD GSPVEEKDHK    360
FWRQTHIPTI PISTRQGKEL LSRLSSGGVT VDDGNSDRSN SGKMGDVLID VDLQTNVREK    420
HPIPNIVGKI EGREQSDKAI IIAASRNSIN FGTTYPNFGT AALLSIVQLF QEVKYKFGWK    480
PLRNIYFISF GGTEFNYAGS SELVEQRLTP LKDEIYSLID ISQLGIPFAE KYENGKTRGE    540
LSIETHPLLK KFFNRNAHGN FDISVDNVQH YGDWTPFLAN GIPVSVISSD STRNRDTPTE    600
TSEDKFERVE KILEDEQNQQ SVKDLLVYLL HISMELIDDP LLHFDIISYV EDIDERLQRL    660
EQAYPEKLNF TSIIKGLLFW KKIGSEWASW TQGWENIVWS HGDGIEPSLL SINRWTWNKK    720
LTNIGRRTCS PAGLPNRSFY KNVLFGPTLI QEDKSKNGGN VDFWTFPGVM DAIYDDDWKR    780
AQEQIDLIGK VLHQSAALFV EETNDIGYK                                      809

SEQ ID NO: 177
atgacctctt tatatgcacc tggggcggag gatattcggc aaaggttacg tcctttggg      60
tttttctttg agaaatcact aaaggatttg attaagggta ttaggtctca caacgaaaca    120
ccagaaaaac tggatcaatt cttttaaaca gtattaagtg aatgccggga agaagtgaac    180
tctccagatc taaattctaa gaccaatgcc gttcttaaat tgacctattt agagatgtac    240
ggtttgaca tggcttggtg caactttcat atcttagagg ttatgagcag taataaactt    300
caacaaaaac gtgtgggta tttggctgca tcacaatctt tttacaaaga ttctgacatt    360
ttgatgcttg caactaactt gttgaaaaaa gacttaaagt atgacggaaa caatgatgtt    420
gttaaagttg gcattgcttt aagtggtctt tccactaaa ttacaccctc attagcaaga    480
gatatagctg atgatttgtt cactatgcta aacagcacaa gaccgtacat aagaaagaag    540
gccattaccg cactatttaa agttttttctg caatatccag aggctttgag agataatttt    600
gataagttg tttcaaagct agacgatgat gatatatctg tggtttctgc cgctgtcagt    660
gttatttgcg agctatcaaa aaaaaacccc caaccattca tccagctttc acctttatta    720
tacgagatat tagttaccat tgacaataac tggataatca ttagattatt gaagttattc    780
accaacttat cacaagtgga accgaaattg agagccaagt tattgccgaa aattttagaa    840
ctgatggaga gtactgttgc aacttctgtg atctatgaat ctgtcaactg tatttgtcaag    900
gggaatatgc tagaagaaga tgattttgaa acagcaatgg catgcctgga aagattgcac    960
acatttgtg attctcagga tccaaatttg agatatatta gctgcatatt gtttctacaag   1020
atcgcaaaa tcaatactga ttttatttct cggttcgacc aactgattat acgcttactc    1080
tccgatgtcg acgtttctat aagatcaaaa gcaattgaat tggttgaagg tattgttgat    1140
gaggataact taaaggcaat tgtccaaaca ttgatgaagc aatttgtaga tgaagatgtg    1200
gttatcctac aaactggaag catcgtatac gaaaaatcaa agagaattcc cataataatt    1260
ccagaaaaatt acaagataaa aatggtgaac gtcattatat cgatttgttc agctgacaac   1320
```

TABLE 3-continued

Sequences disclosed herein.

```
tattccagtg ttaacgactt tgaatggtac aatgcagtaa taatggactt ggcgatgctc   1380
tgtcaagaca tatctgataa aagccttgga tcaaaaattg gtgaacagtt taggaatttg   1440
atgataaaag ttccttcaat gagagaagta accattgcta atattataaa gcttatttca   1500
aatgacaata ttaacaaaca gttgcctacc gtattgagag aatgcatttg gtgtctcgga   1560
gaattttcta ccctagttga aaatggtaac gacttaataa aaatcatgac tgagaatatc   1620
agttattatt ctcatagtgt acaagaagtt ttaattttag cacttgttaa agtatttagt   1680
aattggtgta ataactttca ggaggataaa cgctttgaaa ttaaaatggt gttaaaagag   1740
ctaattgaat tttttgaaaa tttatcttat tcgagtacat tcgaagtcca ggaaagaagc   1800
gtagaagttt tagaattttt aagactaagt ttggaggctt tagaggagga tacggaaggt   1860
ctaccaatgc tactgagcga agtcctgcct agttttttta acgcctatga actcgcacca   1920
attgcgcgtg ggactcaatt gaagttagca gtagatagga atcttgatct agaaactcca   1980
tttttgacaa aggaggcagc tgatgaactc ttagatgaac aaaaaagtga cgccatcagt   2040
gatttaatgt ctgatatctc aatggacgag caagttgaac taaaattcgt tgatgattct   2100
gatacttcgt atgaagaaaa ggaaaaattg gatgattttg aaaatccatt tgagattgag   2160
agagaaaagg aacggatgtc aaatccttat tatctaggtg aagaagacga agaaagaact   2220
aagaactcta aagatttgtt ggacttgaat gaggaggaga gtagtgataa aaagccagaa   2280
actattagat taaatagaac cgataattcg ttgaattctc taagtttatc tacaactgaa   2340
atcagcagaa agaagaagaa gggaaagaag aaaaatagg ttcaagtctt atccgatgaa   2400
cctgttatcg aagccgctcc caaaaggaaa gatgcattcc agaaacccca tgataatcat   2460
tcaactcaaa atcctttgaa aaaggacaag attaatctga gaatgcactc tcaacttgaa   2520
aatttgatt tttccaattt tgggcaatcg agtaacgcag gaagaggatc gcaggaagag   2580
ggcaaccta gaaaggaaga cgagttagaa ttaagtcgtt tagaggccaa tcttattgta   2640
aaagatgaaa aggataattt aagtgatact gaagaagtta tagttataaa aagaagaag   2700
aaagggaaaa agtcaaagtc aaaaaacaaa ctaaaaacga aagcaaaaaa ttctccagaa   2760
ccaaatgaat tcttcgaga ccaaagcact gacatttaa                          2799

SEQ ID NO: 178
MTSLYAPGAE DIRQRLRPFG FFFEKSLKDL IKGIRSHNET PEKLDQFFKQ VLSECREEVN    60
SPDLNSKTNA VLKLTYLEMY GFDMAWCNPH ILEVMSSNKL QQKRVGYLAA SQSFYKDSDI   120
LMLATNLLKK DLKYDGNNDV VKVGIALSGL STIITPSLAR DIADDLFTML NSTRPYIRKK   180
AITALFKVFL QYPEALRDNF DKFVSKLDDD DISVVSAAVS VICELSKKNP QPFIQLSPLL   240
YEILVTIDNN WIIIRLLKLF TNLSQVEPKL RAKLLPKILE LMESTVATSV IYESVNCIVK   300
GNMLEEDDFE TAMACLERLH TFCDSQDPNL RYISCILFYK IGKINTDPIS RFDQLIIRLL   360
SDVDVSIRSK AIELVEGIVD EDNLKAIVQT LMKQFVDEDV VILQTGSIVY EKSKRIPIII   420
PENYKIKMVN VIISICSADN YSSVNDFEWY NAVIMDLAML CQDISDKSLG SKIGEQFRNL   480
MIKVPSMREV TIANIIKLIS NDNINKQLPT VLRECIWCLG EFSTLVENGN DLIKIMTENI   540
SYYSHSVQEV LILALVKVFS NWCNNFQEDK RFEIKMVLKE LIEFFENLSY SSTFEVQERS   600
VEVLEFLRLS LEALEEDTEG LPMLLSEVLP SFFNAYELAP IARGTQLKLA VDENLDLETP   660
FLTKEAADEL LDEQKSDAIS DLMSDISMDE QVELKFVDDS DTSYEEKEKL DDFENPFEIE   720
REKERMSNPY YLGEEDEERT KNSKDLLDLN EEESSDKKPE TIRLNRTDNS LNSLSLSTTE   780
ISRKKKKGKK KNRVQVLSDE PVIEAAPKRK DAFQKPHDNH STQNPLKKDK INLRMHSQLE   840
NFDFSNFGQS SNAGRGSQEE GNLRKEDELE LSRLEANLIV KDEKDNLSDT EEVIVIKKKK   900
KGKKSKSKNK LKTKAKNSPE PNEFLRDQST DI                                 932

SEQ ID NO: 179
atggtagatt caattcaccg tattgcatcg gcgttggata cggccaaagt aataacgagg    60
gaagctgccg cggtagccac ctctaagctg ggtgaatcct cctatactta ttattctcaa   120
aacatcaatc ctcaacagtt agtcacctttg ttaaattcta ggaactctag agaagttaga   180
gatgcaatga agagaataat atctataatg gcttccgatg atgactctat tgacgttcaa   240
ttatactttg ctgatgttgt aaagaatatc accactaatg acaccaaagt gaaaagactt   300
attcacctgt atttacttag atttgcagaa atgacccaa acctgaccct gttatctatt   360
aattctcttc aaaaatcatt gtctgattcg aattccgaac tgagatgctt tgctttgagt   420
gcccttctg acatgaaaat gtcatcatta gcacctataa ttttgcatac tgtcaagaaa   480
ttggttacag atccatctgc aatggttcgt ggtgaagtcg ccttggccat tatcaaatta   540
tatagggctg gaaagaatga ctatcatgaa gaattgttgg atattctgaa agaattaatg   600
gcagatacag atcctaaggt gatatcctgt gctgtcctga cttacaaaga atgttatgcg   660
gatcacttgg agctattgca tggacatttt cgcagatatt gtagaataat taagcaacta   720
gattcgtggt cacaatcata tttaattgag ctgctaatca agtactgtaa gcagtattta   780
ccaaaaccaa ctgtggtcga taaatcatca gaaggttccc caaggagttg tcctttacca   840
gataaataca acgagattga ataccatctc tacgaggtgg taaatgaccc tgatttagat   900
ttatttctac agagtttgaa ttgcttaatt tatagttcca ccctacagt gattttatcg   960
tgttgcaatg cgctatatca gttagcttca ccattgcaga tgaaaaatac taaatttatt  1020
gaagcattgg ttagaacggt aaccatgaca gaaaaccaag gtaacaaaga aatgctttta  1080
caagcaattc acttcttatc gatcttagac agacactat ttttacccta caccaagaaa  1140
ttttacgttt tccccaaaga tcctattgtg gcatcaatttt ggaagatcca aattttgtcc  1200
acgttaataa atgaatcaaa cgttaaagaa atattcaaag aattgaaata ttatgttgcc  1260
agtgctcatt tccagaaaaa tgttgttatt atggcggtta agtcattatc tcgatgtggc  1320
caattgtcaa cgagttggga atcacatgta atgaagtggt taattgatca tatggaatcc  1380
cacaacctct ctgcttctgt cctagatgca tacgtgaatg ttatcaggat gctggtgtca  1440
aaaaatccta caaacatctc tcgcataatc ttcaagcttg cagatttatt aacagttcaa  1500
acgagtttgg ctgataatgc tcgtgcaggt attgtttggt tatttggtga aattgcctcg  1560
attgaattta agatatgtcc ggacgttttg aggaggctaa tccagaattt tcaaatgag  1620
ggtcctgaga caagatgtca gatcttagtg ttatcagcaa aactgttgtc atatgacatt  1680
gataattta agcaagcgca agttactgga agcgaagaaa ataaccaaaa tcccccatac  1740
tatgattta gtggttcaag aatctctcaa atgtacaatg cggtccttta cttggcaaaa  1800
tatgatgacg aatttgatat tagggataga gccaggatga tttcatcctt gtttgattca  1860
gggaaatatg aaattgtgtc actactatta caagcaccta aacctacggc aagaagtgac  1920
gatttatcg tttctgcaag attggaaaca catacccag aaataaaaga attttttaga  1980
```

TABLE 3-continued

Sequences disclosed herein.

```
atgcttcctt ggaatactga aattactgag gttggcgaga caggtaacga tattagagaa   2040
ggcgcagaat tgaaagacta taacaaatac aaaaaaagtt tttcatcgca gtcttttatt   2100
accaacaact cagcaagatc tttcacatct agctccaacg caaaattgac tgggatcaat   2160
gacggcgata gcaatagcat ctcaggtaaa ggtaacgtaa acaccttcac atctcaaaac   2220
gggaagaaat atcgtttgca agcctggac gagtttttt ccgacattcc agaaggaag    2280
agtaaaccaa ggaaaattat aaaggtggtg gaagaaagca gtgacgagga tgaagacgaa   2340
tcggaagaga gcagtgacga tgatgagtat agtgactctt ctttgggaac gtcttcttcg   2400
ggaacgtctt cttcgcatct ggagctttag                                    2430

SEQ ID NO: 180
MVDSIHRIAS ALDTAKVITR EAAAVATSKL GESSYTYYSQ NINPQQLVTL LNSRNSREVR    60
DAMKRIISIM ASDDDSIDVQ LYFADVVKNI TTNDTKVKRL IHLYLLRFAE NDPNLTLLSI   120
NSLQKSLSDS NSELRCFALS ALSDMKMSSL APIILHTVKK LVTDPSAMVR GEVALAIIKL   180
YRAGKNDYHE ELLDILKELM ADTDPKVISC AVLAYKECYA DHLELLHGHF RRYCRIIKQL   240
DSWSQSYLIE LLIKYCKQYL PKPTVVDKSS EGSPRSCPLP DKYNEIEYPS YEVVNDPDLD   300
LFLQSLNCLI YSSNPTVILS CCNALYQLAS PLQMKNTKFI EALVRTVTMT ENQGNKEMLL   360
QAIHFLSILD QTLFLPYTKK FYVFPKDPIV ASIWKIQILS TLINESNVKE IFKELKYYVA   420
SAHFPENVVI MAVKSLSRCG QLSTSWESHV MKWLIDHMES HNLSASVLDA YVNVIRMLVQ   480
KNPTKHLRII FKLADLLTVQ TSLADNARAG IVWLFGEIAS IEFKICPDVL RRLIQNFSNE   540
GPETRCQILV LSAKLLSYDI DNFKQAQVTG SEENNQNPPY YDFSGSRISQ MYNAVLYLAK   600
YDDEFDIRDR ARMISSLFDS GKYEIVSLLL QAPKPTARSD DFIVSARLET HTPEIKEFFR   660
MLPWNTEITE VGETGNDIRE GAELKDYNKY KKSFSSQSFI TNNSARSFTS SSNAKLTGIN   720
DGDSNSISGK GNVNTFTSQN GKKYRLQSLD EFFSDIPERK SKPRKIIKVV EESSDEDEDE   780
SEESSDDDEY SDSSLGTSSS GTSSSHLEL                                    809

SEQ ID NO: 181
atggtcgcac aaactttcaa cctggatacc tacttatccc aaagacaaca acaagttgaa    60
gaggccctaa gtgctgctct tgtgccagct tatcctgaga gaatatacga agctatgaga   120
tactccctcc tggcaggtgg caaaagatta agacctatct tatgtttagc tgcttgcgaa   180
ttggcaggtg gttctgttga acaagccatg ccaactgcgt gtgcacttga aatgatccat   240
acaatgtcac taattcatga tgacctgcca gccatggata cgatgatttt cagaagagga   300
aagccaacta atcacaaggt gttcgggaa gatatagcca tcttagcggg tgatgcgctt    360
ttagcttacg ctttgaaca tattgcttct caaacaagag gagtaccacc tcaattggtg   420
ctacaagtta ttgctagaat cggacacgcc gttgctgcaa caggcctcgt ggaggccaa    480
gtcgtagacc ttgaatctga aggtaaagct atttccttag aaacattgga gtatattcac   540
tcacataaga ctggagcctt gctggaagca tcagttgtct caggcggtat tctcgcaggg   600
gcagatgaag agcttttggc cagattgtct cattacgcta gagatatagg cttggctttt   660
caaatcgtcg atgatatcct ggatgttact gctacatctg aacagttggg aaaaccgct    720
ggtaaagacc aggcagccgc aaaggcaact tatccaagtc tattgggttt agaagcctct   780
agacagaaag cggaagagtt gattcaatct gctaaggaag ccttaagacc ttacggttca   840
caagcagagc cactcctagc gctggcagac ttcatccacg gtcgtcagca ttaa         894

SEQ ID NO: 182
MVAQTFNLDT YLSQRQQQVE EALSAALVPA YPERIYEAMR YSLLAGGKRL RPILCLAACE    60
LAGGSVEQAM PTACALEMIH TMSLIHDDLP AMDNDDFRRG KPTNHKVFGE DIAILAGDAL   120
LAYAFEHIAS QTRGVPPQLV LQVIARIGHA VAATGLVGGQ VVDLESEGKA ISLETLEYIH   180
SHKTGALLEA SVVSGGILAG ADEELLARLS HYARDIGLAF QIVDDILDVT ATSEQLGKTA   240
GKDQAAAKAT YPSLLGLEAS RQKAEELIQS AKEALRPYGS QAEPLLALAD FITRRQH     297

SEQ ID NO: 183
gcacagcaca catcagaatc cgcagctgtc gcaaagggca gcagtttgac ccctatagtg    60
agaactgacg ctgagtcaag gagaacaaga tggccaaccg atgacgatga cgccgaacct   120
ttagtggatg agatcagggc aatgcttact tccatgtctg atggtgacat ttccgtgagc   180
gcatacgata cagcctgggt cggattggtt ccaagattag acggcggtga aggtcctcaa   240
tttccagcag ctgtgagatg gataagaaat aaccagttgc ctgacggaag ttggggcgat   300
gccgcattat tctctgccta tgacaggctt atcaataccc ttgcctgcgt tgtaactttg   360
acaaggtggt ccctagaacc agagatgaga ggtaggaac tatcttttt gggtaggaac   420
atgtggaaat tagcaactga agatgaagag tcaatgccta ttggcttcga attagcattt   480
ccatctttga tagagcttgc taagagccta ggtgtccatg acttccctta tgatcaccag   540
gccctacaag gaatctactc ttcaagagag atcaaaatga gaggattcc aaaagaagtg    600
atgcataccg ttccaacatc aatattgcac agtttggagg gtatgcctgg cctagattgg   660
gctaaactac ttaaactaca gagcagcgac ggaagttttt tgttctcacc agctgccact   720
gcatatgctt taatgaatac cggagatgac aggtgtttta gctacatcga agaacagta   780
aagaaattca acggcggcgt ccctaatgtt tatccagtgg atctatttga acatatttgg   840
gccgttgata gacttgaaag attaggaatc tccaggtact tccaaaagga gatcgaacaa   900
tgcatggatt atgtaaacag gcattggact gaggacggta tttgttggc aaggaactct   960
gatgtcaaag aggtggacga cacagctatg gcctttagac ttcttaggtt gcacggctac  1020
agcgtcagtc ctgatgtgtt taaaaacttc gaaaaggacg tgaattttt cgcatttgtc   1080
ggacagtcta atcaagctgt taccggtatg tacaacttaa acagagcaag ccagatatcc  1140
ttcccaggcg aggatgtgct tcatagagct ggtgccttct catatgagtt cttgaggaga   1200
aaagaagcag agggagcttt gagggacaag tggatcattt ctaaagatct acctggtgaa  1260
gttgtgtata ctttggattt tccatggtac ggcaacttac ctagagtcga ggccagagac  1320
tacctagagc aatacgagg tggtgatgac gtttggattg agaagacatt gtataggtg   1380
ccacttgtaa acaatgatgt atatttggaa ttggcaagaa tggatttcaa ccactgccag  1440
gctttgcatc agttagagtg gcaaggacta aaaagatggt atactgaaaa taggttgatg  1500
gactttggtg tcgcccaaga agatgccctt agagcttatt ttcttgcagc cgcatctgtt  1560
tacgagcctt gtagagctgc cgagaggctt gcatgggcta gagccgcaat actagctaac  1620
gccgtgagca cccacttaag aaaatagccca tcattcagag aaaggttaga gcattctctt  1680
```

TABLE 3-continued

Sequences disclosed herein.

```
aggtgtagac ctagtgaaga gacagatggc tcctggttta actcctcaag tggctctgat   1740
gcagttttag taaaggctgt cttaagactt actgattcat tagccaggga agcacagcca   1800
atccatggag gtgacccaga agatattata cacaagttgt taagatctgc ttgggccgag   1860
tgggttaggg aaaaggcaga cgctgccgat agcgtgtgca atggtagttc tgcagtagaa   1920
caagagggat caagaatggt ccatgataaa cagacctgtc tattattggc tagaatgatc   1980
gaaatttctg ccggtagggc agctggtgaa gcagccagtg aggacggcga tagaagaata   2040
attcaattaa caggctccat ctgcgacagt cttaagcaaa aaatgctagt ttcacaggac   2100
cctgaaaaaa atgaagagat gatgtctcac gtggatgacg aattgaagtt gaggattaga   2160
gagttcgttc aatatttgct tagactaggt gaaaaaaaga ctggatctag cgaaaccagg   2220
caaacatttt taagtatagt gaaatcatgt tactatgctg ctcattgccc acctcatgtc   2280
gttgatagac acattagtag agtgattttc gagccagtaa gtgccgcaaa gtaaccgcgg   2340

SEQ ID NO: 184
AQHTSESAAV AKGSSLTPIV RTDAESRRTR WPTDDDDAEP LVDEIRAMLT SMSDGDISVS     60
AYDTAWGLV  PRLDGGEGPQ FPAAVRWIRN NQLPDGSWGD AALFSAYDRL INTLACVVTL    120
TRWSLEPEMR GRGLSFLGRN MWKLATEDEE SMPIGFELAF PSLIELAKSL GVHDFPYDHQ    180
ALQGIYSSRE IKMKRIPKEV MHTVPTSILH SLEGMPGLDW AKLLKLQSSD GSFLFSPAAT    240
AYALMNTGDD RCFSYIDRTV KKFNGGVPNV YPVDLFEHIW AVDRLERLGI SRYFQKEIEQ    300
CMDYVNRHWT EDGICWARNS DVKEVDDTAM AFRLLRLHGY SVSPDVFKNF EKDGEFFAFV    360
GQSNQAVTGM YNLNRASQIS FPGEDVLHRA GAFSYEFLRR KEAEGALRDK WIISKDLPGE    420
VVYTLDFPWY GNLPRVEARD YLEQYGGGDD VWIGKTLYRM PLVNNDVYLE LARMDFNHCQ    480
ALHQLEWQGL KRWYTENRLM DFGVAQEDAL RAYFLAAASV YEPCRAAERL AWARAAILAN    540
AVSTHLRNSP SFRERLEHSL RCRPSEETDG SWFNSSSGSD AVLVKAVLRL TDSLAREAQP    600
IHGGDPEDII HKLLRSAWAE WVREKADAAD SVCNGSSAVE QEGSRMVHDK QTCLLLARMI    660
EISAGRAAGE AASEDGDRRI IQLTGSICDS LKQMLVSQD  PEKNEEMMSH VDDELKLRIR    720
EFVQYLLRLG EKKTGSSETR QTFLSIVKSC YYAAHCPPHV VDRHISRVIF EPVSAAK      777

SEQ ID NO: 185
atgtctatta atttgagatc ttccggttgt agctccccaa taagcgcaac tttggaaagg     60
ggtctagact ctgaagttca aacaagagca aacaatgtat cttttgagca gaccaaagag    120
aagatcagga aaatgcttga gaaggtcgag ttgagcgtga gtgcctatga cactagttgg    180
gtagctatgg tcccatcacc atccagtcaa aacgcaccto ttttcccaca gtgcgtcaaa    240
tggctacttg ataatcaaca tgaggacggc tcttgggat  tggataacca cgaccatcag    300
agcttaaaga aagatgtgtt gtcatccaca ttagcctcta tcctagctct taagaaatgg    360
ggaataggcg aaagacagat caataagggt ctacagttca ttgaattaaa ctctgcacta    420
gttaccgatg aaactataca aaaacctaca ggtttcgaca tcatttttcc aggaatgatt    480
aagtacgcca gggaccttaa tttgaccata cctcttggct cagaagtagt cgacgatatg    540
atcaggaaaa gagatctaga cttaaagtgt gatagcgaga aattcagcaa aggtagagag    600
gcttatcttg cctatgttct tgaaggaact aggaacttga aggactggga cttaattgtg    660
aaatatcaga gaaagaacgg tagtctattt gatagtccga ctacaaccgc cgcagctttc    720
actcaatttg gcaatgacgg ttgcttgagg tacttatgtt cactttttaca gaaattcgag    780
gccgcagtgc ctagtgtata tccatttgat caatacgcta gattaagcat aatcgtcact    840
ttagaatcat tgggaattga cagagatttc aagactgaga taaaaagcat attggatgag    900
acctataggt actggcttag aggtgacgaa gaaatttgcc tagatttggc cacatgttca    960
cttgctttta ggttgctttt agcccacggc tatgacgtgt catacgatcc tctaaagcca   1020
tttgcagagg aatctggttt cagcgatacc cttgagggat atgttaaaaa caccttttcc   1080
gtattagagc ttttcaaggc tgcccaaagt taccctcatg agagtgcttt gaaaaagcag   1140
tgttgctgga caaacaata  tctagaaatg gaactaagtt catgggttaa aacaagcgtt   1200
agggacaagt acttgaaaaa ggaagtggag gatgctttgg catttccatc atatgcctct   1260
ttagaaagaa gtgaccacag aaggaaaatt cttaatggct cagcagttga aaacacaaga   1320
gtaaccaaga cctcttacag gttgcataat atatgtacat cagatatctt aaaacttgct   1380
gtcgacgatt tcaacttttg ccaatctatt catagagagg aaatggaaag attggataga   1440
tggatagtgg agaatagact acaggaatta aagttcgcca gacaaaaatt ggcttactgt   1500
tactttagtg gcgctgccac actattctct ccagaattgt ctgacgcaag gatctcatgg   1560
gctaagggag gtgttctaac cacagtagtc gatgactttt ttgatgttgg cggtagtaaa   1620
gaagagcttg agaacttaat tcacttggtg gaaaagtggg atcttaatgg agttcctgaa   1680
tactcttcag agcatgtaga aataattttc tctgtcctaa gacactat   cttagaaacc   1740
ggtgataaag cctttacata tcagggcaga aacgttactc accatattgt gaaaatatgg   1800
ttggacttac ttaagagcat gctaaggag  gctgaatggt ccagtgacaa atcaaccccca  1860
tctttggaag attacatgga gaatgcctat atcagcttcg cattaggtcc tattgtattg   1920
ccagctacat acctttatagg acctccacta cctgaaaaga ctgtcgactc ccaccaatat   1980
aatcaattat acaaattggt tagtaccatg ggtagactat taaacgatat ccagggcttt   2040
aagagggaat cagccgaggg aaaacttaat gcagtgtctc tacatatgaa gcatgaaaga   2100
gacaacagaa gcaagaggt  tattatagaa tccatgaaag gattggctga aggaaaaga   2160
gaggaattac acaaacttgt actagaagag aaaggtagtc tcgttccaga agaatgcaag   2220
gaagccttct taaaaatgtc aaaagtgttg aacctttttt ataggaagga tgatggcttc   2280
acatctaacg acttgatgag ccttgtgaaa tccgtcatct acgagcctgt ttcacttcaa   2340
aaggagagtc taacttga                                                2358

SEQ ID NO: 186
MSINLRSSGC SSPISATLER GLDSEVQTRA NNVSFEQTKE KIRKMLEKVE LSVSAYDTSW     60
VAMVPSPSSQ NAPLFPQCVK WLLDNQHEDG SWGLDNHDHQ SLKKDVLSST LASILALKKW    120
GIGERQINKG LQFIELNSAL VTDETIQKPT GFDIIFPGMI KYARDLNLTI PLGSEVVDDM    180
IRKRDLDLKC DSEKFSKGRE AYLAYVLEGT RNLKDWDLIV KYQRKNGSLF DSPATTAAAF    240
TQFGNDGCLR YLCSLLQKFE AAVPSVYPFD QYARLSIIVT LESLGIDRDF KTEIKSILDE    300
TYRYWLRGDE EICLDLATCA LAFRLLLAHG YDVSYDPLKP FAEESGFSDT LEGYVKNTFS    360
VLELFKAAQS YPHESALKKQ CCWTKQYLEM ELSSWVKTSV RDKYLKKEVE DALAFPSYAS    420
LERSDHRRKI LNGSAVENTR VTKTSYRLHN ICTSDILKLA VDDFNFCQSI HREEMERLDR    480
```

TABLE 3-continued

Sequences disclosed herein.

| | | | | |
|---|---|---|---|---|
| WIVENRLQEL | KFARQKLAYC | YFSGAATLFS | PELSDARISW | AKGGVLTTVV | DDFFDVGGSK | 540 |
| EELENLIHLV | EKWDLNGVPE | YSSEHVEIIF | SVLRDTILET | GDKAFTYQGR | NVTHHIVKIW | 600 |
| LDLLKSMLRE | AEWSSDKSTP | SLEDYMENAY | ISFALGPIVL | PATYLIGPPL | PEKTVDSHQY | 660 |
| NQLYKLVSTM | GRLLNDIQGF | KRESAEGKLN | AVSLHMKHER | DNRSKEVIIE | SMKGLAERKR | 720 |
| EELHKLVLEE | KGSVVPRECK | EAFLKMSKVL | NLFYRKDDGF | TSNDLMSLVK | SVIYEPVSLQ | 780 |
| KESLT | | | | | | 785 |

SEQ ID NO: 187

```
atggatgctg tgacgggttt gttaactgtc ccagcaaccg ctataactat tggtggaact    60
gctgtagcat tggcggtagc gctaatcttt tggtacctga atcctacac atcagctaga   120
agatcccaat caaatcatct tccaagagtg cctgaagtcc caggtgttcc attgttagga   180
aatctgttac aattgaagga gaaaaagcca tacatgactt ttacgagatg ggcagcgaca   240
tatgggccta tctatagtat caaaactggg gctacaagta tggttgtggt atcatctaat   300
gagatagcca aggaggcatt ggtgaccaga ttccaatcca tatctacaag gaacttatct   360
aaagccctga aagtacttac agcagataag acaatgctga caatgtcaga ttatgatgat   420
tatcataaaa cagttaagag acacatactg accgccgtct tgggtcctaa tgcacagaaa   480
aagcatagaa ttcacagaga tatcatgatg gataacatat ctactcaact tcatgaattc   540
gtgaaaaaca acccagaaca ggaagaggta gaccttagaa aaatctttca atctgagtta   600
ttcggcttag ctatgagaca agccttagga aaggatgttg aaagtttgta cgttgaagac   660
ctgaaaatca ctatgaatag agacgaaatc tttcaagtcc ttgttgttga tccaatgatg   720
ggagcaatcg atgttgattg gagagacttc tttccatacc taaagtgggt cccaaacaaa   780
aagttcgaaa atactattca acaaatgtac atcagaagag aagctgttat gaaatcttta   840
atcaaagagc acaaaaagag aatagctcta ggcgaaaagc taaatagtta tatcgattac   900
cttttatctg aagctcaaac tttaaccgat cagcaactat tgatgtcctt gtgggaacca   960
atcattgaat cttcagatac aacaatggtc acaacagaat gggcaatgta cgaattagct  1020
aaaaaccccta aattgcaaga taggttgtac agagacatta gtccgtctg tgggatctgaa  1080
aagataaccg aagagcatct atcacagctg ccttacatta cagctatttt ccacgaaaca  1140
ctgagaagac actcaccagt tcctatcatt cctctaagac atgtacatga agataccgtt  1200
ctaggcggct accatgttcc tgctggcaca gaacttgccg ttaacatcta cggttgcaac  1260
atggacaaaa acgtttggga aaatccagag gaatggaacc cagaaagatt catgaaagag  1320
aatgagacaa ttgattttca aaagacgatg gccttcggtg gtggtaagag agtttgtgct  1380
ggttccttgc aagcccttttt aactgcatct attgggattg ggagaatggt tcaagagttc  1440
gaatggaaac tgaaggatat gactcaagag gaagtgaaca cgataggcct aactacacaa  1500
atgttaagac cattgagagc tattatcaaa cctaggatct aa                    1542
```

SEQ ID NO: 188

| | | | | |
|---|---|---|---|---|
| MDAVTGLLTV | PATAITIGGT | AVALAVALIF | WYLKSYTSAR | RSQSNHLPRV | PEVPGVPLLG |  60 |
| NLLQLKEKKP | YMTFTRWAAT | YGPIYSIKTG | ATSMVVVSSN | EIAKEALVTR | FQSISTRNLS | 120 |
| KALKVLTADK | TMVAMSDYDD | YHKTVKRHIL | TAVLGPNAQK | KHRIHRDIMM | DNISTQLHEF | 180 |
| VKNNPEQEEV | DLRKIFQSEL | FGLAMRQALG | KDVESLYVED | LKITMNRDEI | FQVLVVDPMM | 240 |
| GAIDVDWRDF | FPYLKWVPNK | KFENTIQQMY | IRREAVMKSL | IKEHKKRIAS | GEKLNSYIDY | 300 |
| LLSEAQTLTD | QQLLMSLWEP | IIESSDTTMV | TTEWAMYELA | KNPKLQDRLY | RDIKSVCGSE | 360 |
| KITEEHLSQL | PYITAIFHET | LRRHSPVPII | PLRHVHEDTV | LGGYHVPAGT | ELAVNIYGCN | 420 |
| MDKNVWENPE | EWNPERFMKE | NETIDFQKTM | AFGGGKRVCA | GSLQALLTAS | IGIGRMVQEF | 480 |
| EWKLKDMTQE | EVNTIGLTTQ | MLRPLRAIIK | PRI | | | 513 |

SEQ ID NO: 189

```
atgtcttcct cttcctcttc cagtacctct atgattgatt tgatggctgc tattattaaa    60
ggtgaaccag ttatcgtctc cgacccagca aatgcctctg cttatgaatc agttgctgca   120
gaattgtctt caatgttgat cgaaaacaga caattcgcca tgatcgtaac tacatcaatc   180
gctgttttga tcggttgtat tgtcatgttg gtatggagaa gatccggtag tggtaattct   240
aaaagagtcg aacctttgaa accattagta attaagcgaa gagaagaaga aatagatgac   300
ggtagaaaga aagttacaat atttttcggt acccaaactg gtacagctga aggttttgca   360
aaagccttag gtgaagaagc taaggcaaga tacgaaaaga ctagattcaa gatagtcgat   420
ttggatgact atgccgctga tgacgatgaa tacgaagaaa gttgaagaa agaagatgtt   480
gcattttttct ttttggcaac ctatggtgac ggtgaaccaa ctgacaatgc agccagattc   540
tacaaatggt ttacagaggg taatgatcgt ggtgaatggt tgaaaaactt aaagtacggt   600
gttttcggtt tgggtaacag acaatacgaa catttcaaca aagttgcaaa ggttgtcgac   660
gatattttgg tcgaacaagg tgctcaaaga ttagtccaag taggtttggg tgacgatgac   720
caatgtatag aagatgactt tactgcctgg agagaagctt tgtggcctga attagacaca   780
atcttgagag aagaaggtga caccgccgtt gctaccccat atactgctgc agttattagaa   840
tacagagttt ccatccatga tagtgaagac gcaaagttta atgatatcac tttggccaat   900
ggtaacggtt atacagtttt cgatgcacaa caccccttaca aagctaacgt tgcagtcaag   960
agagaattac atacaccaga tccgacaga gttgtatac acttggaatt tgatatcgct  1020
ggttccggtt taaccatgaa gttgggtgac ttttatgcga caatttgtct  1080
gaaactgttg atgaagcatt gagattgttg gatatgtccc ctgacactta tttagtttg  1140
cacgctgaaa agaagatgg tacaccaatt tccagttctt taccactcc attccctcca  1200
tgtaacttaa gaacagcctt gaccagatac gcttgcttgt tatcatcccc taaaaagtcc  1260
gccttggttg ctttagccgc tcatgctagt gatcctactg aagcagaaag attgaaacac  1320
ttagcatctc cagccggtaa agataatat tcaaagtggg tagttgaatc tcaaagatca  1380
ttgttagaag ttatggcaga attccatct gccaagcctc cattaggtgt cttctttgct  1440
ggtgtagcac ctagattgca accaagattc tactcaatca gttcttcacc taagatcgct  1500
gaaagaa ttcatgttac atgtcatta gtctacgaaa agatgccaac cggtagaatt  1560
cacaagggtg tatgctctac ttggatgaaa aatgctgttc cttacgaaa atcgctagaag  1620
ttgttcttag gtagaccaat cttcgtaaga caatcaaact tcaagttgcc ttctgattca  1680
aaggttccaa taatcatgat aggtcctggt acaggtttag ccccattcag aggtttcttg  1740
caagaaagat tggctttagt tgaatctggt gtcgaattag tccttcagt tttgttcttt  1800
ggttgtagaa acagaagaat ggatttcatc tatgaagaag aattgcaaag attcgtcgaa  1860
```

TABLE 3-continued

Sequences disclosed herein.

```
tctggtgcat tggccgaatt atctgtagct ttttcaagag aaggtccaac taaggaatac   1920
gttcaacata agatgatgga taaggcatcc gacatatgga acatgatcag tcaaggtgct   1980
tatttgtacg tttgcggtga cgcaaagggt atggccagag atgtccatag atctttgcac   2040
acaattgctc aagaacaagg ttccatggat agtaccaaag ctgaaggttt cgtaaagaac   2100
ttacaaactt ccggtagata cttgagagat gtctggtga                          2139

SEQ ID NO: 190
MSSSSSSSTS MIDLMAAIIK GEPVIVSDPA NASAYESVAA ELSSMLIENR QFAMIVTTSI     60
AVLIGCIVML VWRRSGSGNS KRVEPLKPLV IKPREEEIDD GRKKVTIFFG TQTGTAEGFA    120
KALGEEAKAR YEKTRFKIVD LDDYAADDDE YEEKLKKEDV AFFFLATYGD GEPTDNAARF    180
YKWFTEGNDR GEWLKNLKYG VFGLGNRQYE HFNKVAKVVD DILVEQGAQR LVQVGLGDDD    240
QCIEDDFTAW REALWPELDT ILREEGDTAV ATPYTAAVLE YRVSIHDSED AKFNDITLAN    300
GNGYTVFDAQ HPYKANVAVK RELHTPESDR SCIHLEFDIA GSGLTMKLGD HVGVLCDNLS    360
ETVDEALRLL DMSPDTYFSL HAEKEDGTPI SSSLPPPFPP CNLRTALTRY ACLLSSPKKS    420
ALVALAAHAS DPTEAERLKH LASPAGKDEY SKWVVESQRS LLEVMAEFPS AKPPLGVFFA    480
GVAPRLQPRF YSISSSPKIA ETRIHVTCAL VYEKMPTGRI HKGVCSTWMK NAVPYEKSEK    540
LFLGRPIFVR QSNFKLPSDS KVPIIMIGPG TGLAPFRGFL QERLALVESG VELGPSVLFF    600
GCRNRRMDFI YEEELQRFVE SGALAELSVA FSREGPTKEY VQHKMMDKAS DIWNMISQGA    660
YLYVCGDAKG MARDVHRSLH TIAQEQGSMD STKAEGFVKN LQTSGRYLRD VW            712

SEQ ID NO: 191
atggaagcct cttacctata catttctatt ttgcttttac tggcatcata cctgttcacc    60
actcaactta gaaggaagag cgctaatcta ccaccaaccg tgtttccatc aataccaatc   120
attggacact tatacttact caaaaagcct ctttatagaa ctttagcaaa aattgccgct   180
aagtacggac caatactgca attacaactc ggctacagag tgttctggt gatttcctca   240
ccatcagcag cagaagagtg ctttaccaat aacgatgtaa tcttcgcaaa tagacctaag   300
acattgtttg gcaaaatagt gggtggaaca tcccttggca tcttatccta cggcgatcaa   360
tggcgtaatc taaggagagt agcttctatc gaaatcctat cagttcatag gttgaacgaa   420
tttcatgata tcagagtgga tgagaacaga ttgttaatta gaaaaacttag aagttcatct   480
tctcctgtta ctcttataac agtcttttat gctctaacat gaacgtcat tatgagaatg    540
atctctggca aaagatattt cgacagtggg gatagagaat ggaggagga aggtaagaga    600
tttcgagaaa tcttagacga aacgtgctt ctagccggtg cttctaatgt tggcgactac    660
ttaccaatat tgaactggtt gggagttaag tctcttgaaa agaaattgat cgctttgcag    720
aaaaaagagag atgactttttt ccagggtttg attgaacagg ttagaaaatc tcgtggtgct    780
aaagtaggca aaggtagaaa aacgatgatc gaactcttat tatctttgca agagtcagaa    840
cctgagtact atacagatgc tatgataaga tcttttgtcc taggtctgct ggctgcaggt    900
agtgatactt cagcgggcac tatggaatgg gccatgagct tactggtcaa tcaccccact    960
gtattgaaga aagctcaagc tgaaatcgat agagttatcg gtaataacag attgattgac   1020
gagtcagaca ttggaaatat ccccttacatc gggtgtatta tcaatgaaac tctaagactc   1080
tatccagcag ggccattgtt gttcccacat gaaagttcg gcgactgct tatttccggt    1140
tacaatatac ctagaggtac aatgttaatc gtaaaccaat gggcgattca tcacgatcct   1200
aaagtctggg atgatcctga aacctttaaa cctgaaagat ttcaaggatt agaaggaact   1260
agagatggtt tcaaacttat gccattcggt tctgggagaa gaggatgtcc aggtgaaggt   1320
ttggcaataa ggctgttagg gatgacacta ggctcagtga tccaatgttt tgattggag    1380
agagtaggag atgagatggt tgacatgaca gaaggtttgg gtgtcacact tcctaaggcc   1440
gttccattag ttgccaaatg taagccacgt tccgaaatga ctaatctcct atccgaactt   1500
taa                                                                 1503

SEQ ID NO: 192
MEASYLYISI LLLLASYLFT TQLRRKSANL PPTVFPSIPI IGHLYLLKKP LYRTLAKIAA     60
KYGPILQLQL GYRRVLVISS PSAAEECFTN NDVIFANRPK TLFGKIVGGT SLGSLSYGDQ    120
WRNLRRVASI EILSVHRLNE FHDIRVDENR LLIRKLRSSS SPVTLITVFY ALTLNVIMRM    180
ISGKRYFDSG DRELEEEGKR FREILDETLL LAGASNVGDY LPILNWLGVK SLEKKLIALQ    240
KKRDDFFQGL IEQVRKSRGA KVGKGRKTMI ELLLSLQESE PEYYTDAMIR SFVLGLLAAG    300
SDTSAGTMEW AMSLLVNHPH VLKKAQAEID RVIGNNRLID ESDIGNIPYI GCIINETLRL    360
YPAGPLLFPH ESSADCVISG YNIPRGTMLI VNQWAIHHDP KVWDDPETFK PERFQGLEGT    420
RDGFKLMPFG SGRRGCPGEG LAIRLLGMTL GSVIQCFDWE RVGDEMVDMT EGLGVTLPKA    480
VPLVAKCKPR SEMTNLLSEL                                                500

SEQ ID NO: 193
atgcaatcta actccgtgaa gatttcgccg cttgatctgg taactgcgct gtttagcggc    60
aaggttttgg acacatcgaa cgcatcggaa tcgggagaat ctgctatgct gccgactata   120
gcgatgatta tggagaatcg tgagctgttg atgatactca caacgtcggt tgctgtattg   180
atcggatgcg ttgtcgtttt ggtgtggcgg agatcgtcta cgaagaagtc ggcgttggag   240
ccaccggtga ttgtggttcc gaagagagtg caagaggagg aagttgatga tggtaagaag   300
aaagttacgg tttctcttcgg cacccaaact ggaacagctg aaggcttcgc taaggcactt   360
gttgaggaag ctaaagctcg atatgaaaag gctgtctta aagtaattga tttgatgat    420
tatgctgctg atgacgatga gtatgaggag aaactaaaga aagaatcttt ggccttttc    480
ttttggcta cgtatggaga tggtgagcca acagataagt ctgccagatt ttataaatgg   540
tttactgagg gagatgcgaa aggagaatgg cttaataagc ttcaatatgg agtatttggt   600
ttgggtaaca gacaatatga acatttttaac aagatcgcaa aagtggttga tgatggtctt   660
gtagaacagg gtgcaaagcg tcttgttcct gttggacttg gagatgatga tcaatgtatt   720
gaagatgact tcaccgcatg gaaagagtta tggatgccga agttgataca attacttcgt   780
gatgaggatg acacaactgt tgctactcca tacacagctg ctgttgcaga atatcgcgtt   840
gttttcatg aaaaaccaga cgcgcttttct gaagattata gttatacaaa tggccatgct    900
gttcatgatg ctcaacatcc atgcagatcc aacgtggctg tcaaaaagga acttcatagt    960
cctgaatctg accggtcttg cactcatctt gaatttgaca tctcgaacac cggactatca   1020
tatgaaactg ggaccatgt tggagtttac tgtgaaaact tgagtgaagt tgtgaatgat   1080
```

TABLE 3-continued

Sequences disclosed herein.

```
gctgaaagat tagtaggatt accaccagac acttactcct ccatccacac tgatagtgaa   1140
gacgggtcgc cacttggcgg agcctcattg ccgcctcctt tcccgccatg cactttaagg   1200
aaagcattga cgtgttatgc tgatgttttg agttctccca agaagtcggc tttgcttgca   1260
ctagctgctc atgccaccga tcccagtgaa gctgatagat tgaaatttct tgcatccccc   1320
gccgaaagg atgaatattc tcaatggata gttgcaagcc aaagaagtct ccttgaagtc    1380
atggaagcat tcccgtcagc taagccttca cttggtgttt tctttgcatc tgttgccccg   1440
cgcttacaac caagatacta ctctatttct tcctcaccca agatgcgacc ggataggatt   1500
catgttacat gtgcattagt ctatgagaaa acacctgcag gccgcatcca caaaggagtt   1560
tgttcaactt ggatgaagaa cgcagtgcct atgaccgaga gtcaagattg cagttgggcc   1620
ccaatatacg tccgaacatc caatttcaga ctaccatctg accctaaggt cccggttatc   1680
atgattggac ctggcactgg tttggctcct tttagaggtt tccttcaaga gcggttagct   1740
ttaaaggaag ccggaactga cctcggttta tccattttat tcttcggatg taggaatcgc   1800
aaagtggatt tcatatatga aaacgagctt aacaactttg tggagactgg tgctctttct   1860
gagcttattg ttgctttctc ccgtgaaggc ccgactaagg aatatgtgca acacaagatg   1920
agtgagaagg cttccggatat ctggaacttg cttctgaag gagcatattt atacgtatgt   1980
ggtgatgcca aaggcatggc caaagatgta catcgaaccc tccacacaat tgtgcaagaa   2040
cagggatctc ttgactcgtc aaaggcagaa ctctacgtga agaatctaca aatgtcagga   2100
agatacctcc gtgacgtttg gtaa                                           2124

SEQ ID NO: 194
MQSNSVKISP LDLVTALFSG KVLDTSNASE SGESAMLPTI AMIMENRELL MILTTSVAVL     60
IGCVVVLVWR RSSTKKSALE PPVIVVPKRV QEEEVDDGKK KVTVFFGTQT GTAEGFAKAL    120
VEEAKARYEK AVFKVIDLDD YAADDDEYEE KLKKESLAFF FLATYGDGEP TDNAARFYKW    180
FTEGDAKGEW LNKLQYGVFG LGNRQYEHFN KIAKVVDDGL VEQGAKRLVP VGLGDDDQCI    240
EDDFTAWKEL VWPELDQLLR DEDDTTVATP YTAAVAEYRV VPHEKPDALS EDYSYTNGHA    300
VHDAQHPCRS NVAVKKELHS PESDRSCTHL EFDISNTGLS YETGDHVGVY CENLSEVVND    360
AERLVGLPPD TYSSIHTDSE DGSPLGGASL PPPFPPCTLR KALTCYADVL SSPKKSALLA    420
LAAHATDPSE ADRLKFLASP AGKDEYSQWI VASQRSLLEV MEAFPSAKPS LGVFFASVAP    480
RLQPRYYSIS SSPKMAPDRI HVTCALVYEK TPAGRIHKGV CSTWMKNAVP MTESQDCSWA    540
PIYVRTSNFR LPSDPKVPVI MIGPGTGLAP FRGFLQERLA LKEAGTDLGL SILFFGCRNR    600
KVDFIYENEL NNFVETGALS ELIVAFSREG PTKEYVQHKM SEKASDIWNL LSEGAYLYVC    660
GDAKGMAKDV HRTLHTIVQE QGSLDSSKAE LYVKNLQMSG RYLRDVW                  707

SEQ ID NO: 195
atggatgcaa tggcaactac tgagaaaaag cctcatgtga tcttcattcc atttcctgca    60
caatctcaca taaaggcaat gctaaagtta gcacaactat tacaccataa gggattacag   120
ataactttcg tgaataccga cttcatccat aatcaatttc tggaatctag tggccctcat   180
tgtttggacg gagccccagg gtttagattc gaaacaattc ctgacggtgt ttcacattcc   240
ccagaggcct ccatcccaat aagagagagt ttactgaggt caatagaaac caactttttg   300
gatcgtttca ttgacttggt cacaaaactt ccagacccac caacttgcat aatctctgat   360
ggctttctgt cagtgtttac tatcgacgct gccaaaaagt tgggtatccc agttatgatg   420
tactggactc ttgctgcatg cggtttcatg ggtttctatc acatccattc tcttatcgaa   480
aagggttttg ctccactgaa agatgcatca tacttaacca acggctacct ggatactgtt   540
attgactggg taccaggtat ggaaggtata agacttaaag attttccttt ggattggtct   600
acagaccta atgataaagt attgatgttt actacagaag ctccacaaag atctcataag   660
gtttcacatc atatctttca cacctttgat gaattggaac catcaatcat caaaaccttg   720
tctctaagat acaatcatat ctacactatt ggtccattac aattacttct agatcaaatt   780
cctgaagaga aaaagcaaac tggtattaca tccttacacg gctactcttt agtgaaagag   840
gaaccagaat gttttcaatg gctacaaagt aaagagccta attctgtggt ctacgtcaac   900
ttcggaagta aacagtcat gtccttgaaa gatatgactg aatttggttg gggccttgct   960
aattcaaatc attactttct atggattatc aggtccaatt tggtaatagg ggaaaacgcc   1020
gtattacctc cagaattgga ggaacacatc aaaaagagag gtttcattgc ttcctggtct   1080
tctcaggaaa aggtattgaa acatccttct gttggtggtt tccttactca ttgcggttgg   1140
ggctctacaa tcgaatcact aagtgcagga gttccaatga tttgttgcc atattcatgg   1200
gaccaactta caaattgtag gtatatctgt aaagagtggg aagttggatt agaaatggga   1260
acaaaggtta acgtgatga agtgaaaaga ttggttcagg agttgatggg ggaaggtggc   1320
cacaagatga gaaacaaggc caaagattgg aaggaaaaag ccagaattgc tattgctcct   1380
aacgggtcat cctctctaaa cattgataag atggtcaaag agattacagt cttagccaga   1440
aactaa                                                              1446

SEQ ID NO: 196
MDAMATTEKK PHVIFIPFPA QSHIKAMLKL AQLLHHKGLQ ITFVNTDFIH NQFLESSGPH     60
CLDGAPGFRF ETIPDGVSHS PEASIPIRES LLRSIETNFL DRFIDLVTKL PDPPTCIISD    120
GFLSVFTIDA AKKLGIPVMM YWTLAACGFM GFYHIHSLIE KGFAPLKDAS YLTNGYLDTV    180
IDWVPGMEGI RLKDFPLDWS TDLNDKVLMF TTEAPQRSHK VSHHIFHTFD ELEPSIIKTL    240
SLRYNHIYTI GPLQLLLDQI PEEKKQTGIT SLHGYSLVKE EPECFQWLQS KEPNSVVYVN    300
FGSTTVMSLE DMTEFGWGLA NSNHYFLWII RSNLVIGENA VLPPELEEHI KKRGFIASWC    360
SQEKVLKHPS VGGFLTHCGW GSTIESLSAG VPMICWPYSW DQLTNCRYIC KEWEVGLEMG    420
TKVKRDEVKR LVQELMGEGG HKMRNKAKDW KEKARIAIAP NGSSSLNIDK MVKEITVLAR    480
N                                                                    481

SEQ ID NO: 197
atggcggaac aacaaaagat caagaaatca ccacacgttc tactcatccc attcccttta    60
caaggccata taaacccttt catccagttt ggcaaacgat taatctccaa aggtgtcaaa   120
acaacacttg ttaccaccat ccacacctta aactcaaccc taaaccacag taacaccacc   180
accacctcca tcgaaatcca agcaatttcc gatggttgtg atgaaggcgg ttttatgagt   240
gcaggagaat catatttgga aacattcaaa caagttgggt ctaaatcact agctgactta   300
atcaagaagc ttcaaagtga aggaaccaca attgatgcaa tcatttatga ttctatgact   360
```

TABLE 3-continued

Sequences disclosed herein.

```
gaatgggttt tagatgttgc aattgagttt ggaatcgatg gtggttcgtt tttcactcaa    420
gcttgtgttg taaacagctt atattatcat gttcataagg gtttgatttc tttgccattg    480
ggtgaaactg tttcggttcc tggatttcca gtgcttcaac ggtgggagac accgttaatt    540
ttgcagaatc atgagcaaat acagagccct tggtctcaga tgttgtttgg tcagtttgct    600
aatattgatc aagcacgttg ggtcttcaca aatagttttt acaagctcga ggaagaggta    660
atagagtgga cgagaaagat atggaacttg aaggtaatcg ggccaacact tccatcccatg   720
taccttgaca aacgacttga tgatgataaa gataacggat ttaatctcta caaagcaaat    780
catcatgagt gcatgaactg gttagacgat aagccaaagg aatcagttgt ttacgtagca    840
tttggtagcc tggtgaaaca tgggcccgaa caagtggaag aaatcacacg ggctttaata    900
gatagtgatg tcaacttctt gtgggttatc aaacataaag aagagggaaa gctcccagaa    960
aatctttcgg aagtaataaa aaccggaaag ggtttgattg tagcatggtg caaacaattg   1020
gatgtgttag cacacgaatc agtaggatgc tttgttacac attgtgggtt caactcaact   1080
cttgaagcaa taagtcttgg agtccccgtt gttgcaatgc ctcaattttc ggatcaaact   1140
acaaatgcca agcttctaga tgaaattttg ggtgttggag ttagagttaa ggctgatgag   1200
aatgggatag tgagaagagg aaatcttgcg tcatgtatta agatgattat ggaggaggaa   1260
agaggagtaa taatccgaaa gaatgcggta aaatggaagg attggctaa agtagccgtt    1320
catgaaggtg gtagctcaga caatgatatt gtcgaatttg taagtgagct aattaaggct   1380
taaattttg ttgctttgta ttttatgtgt tatggttttt tgatttagat gtattcaatt    1440
aatattgaat cataactaaa ttcaagatta ttgtttgtaa tattctttgt cctaaaattt   1500
tgcgacttaa aacctttagt ttataaaaag aaattagaaa atactattgc acgga         1555

SEQ ID NO: 198
MAEQQKIKKS PHVLLIPFPL QGHINPFIQF GKRLISKGVK TTLVTTIHTL NSTLNHSNTT     60
TTSIEIQAIS DGCDEGGFMS AGESYLETFK QVGSKSLADL IKKLQSEGTT IDAIIYDSMT    120
EWVLDVAIEF GIDGGSFFTQ ACVVNSLYYH VHKGLISLPL GETVSVPGFP VLQRWETPLI    180
LQNHEQIQSP WSQMLFGQFA NIDQARWVFT NSFYKLEEEV IEWTRKIWNL KVIGPTLPSM    240
YLDKRLDDDK DNGFNLYKAN HHECMNWLDD KPKESVVYVA FGSLVKHGPE QVEEITRALI    300
DSDVNFLWVI KHKEEGKLPE NLSEVIKTGK GLIVAWCKQL DVLAHESVGC FVTHCGFNST    360
LEAISLGVPV VAMPQFSDQT TNAKLLDEIL GVGVRVKADE NGIVRRGNLA SCIKMIMEEE    420
RGVIIRKNAV KWKDLAKVAV HEGGSSDNDI VEFVSELIKA                          460

SEQ ID NO: 199
atggaaaaca agaccgaaac aacagttaga cgtaggcgta gaatcattct gtttccagta     60
ccttttcaag ggcacatcaa tccaatacta caactagcca acgttttgta ctctaaaggt    120
ttttctatta caatctttca caccaatttc aacaaaccaa aaacatccaa ttacccacat    180
ttcacattca gattcatact tgataatgat ccacaagatg aacgtatttc aaacttacct    240
acccacggtc ctttagctgg aatgagaatt ccaatcatca atgaacatgg tgccgatgag    300
cttagaagag aattagagtt acttatgttg gcatccgaag aggacgagga agtctcttgt    360
ctgattactg acgctctatg gtactttgcc caatctgtgg ctgatagttt gaatttgagg    420
agattggtac taatgacatc cagtctgttt aactttcacg ctcatgttag tttaccacaa    480
tttgacgaat tgggatactt ggaccctgat gacaagacta ggttagagga acaggcctct    540
ggttttccta tgttgaaagt caaagatatc aagtctgcct attctaattg caaatcttg     600
aaagagatct taggaaagat gatcaaacag acaaaggctt catctggagt gatttggaac    660
agtttcaaag agttagaaga gtctgaattg gagactgttag tcagagaaat tccagcacct    720
tcattcctga taccattacc aaaacatttg actgcttcct cttcctcttt gttggatcat    780
gacagaacag ttttttcaatg gttggaccaa caaccaccta gttctgtttt gtacgtgtca    840
tttggtagta cttctgaagt cgatgaaaag gacttccttg aaatcgcaag aggcttagtc    900
gatagtaagc agtcattcct ttgggtcgtg gtcgtcaaggt tcgtgaaagg ctcaacatgg    960
gtcgaaccac ttccagatgg tttttctaggc gaaaggtta gaatagtcaa atggggttcct  1020
caacaggaag ttttagctca tggcgctatt ggggcattct ggactcattc cggatggaat   1080
tcaactttag aatcagtatg cgaagggtta cctatgatct tttcagattt tggtcttgat   1140
caaccactga acgcaagata catgtctgat gtttttgaag tgggtgtata tctagaaaat   1200
ggctgggaaa ggggtgaaat agctaatgca ataagcgtg ttatggttga tgaagagggg    1260
gagtatatca gacaaaacgc aagagtgctg aagcaaaagg ccgacgtttc tctaatgaag   1320
ggaggctctt catacgaatc cttagaatct cttgtttcct acatttcatc actgtaa       1377

SEQ ID NO: 200
MENKTETTVR RRRRIILFPV PFQGHINPIL QLANVLYSKG FSITIFHTNF NKPKTSNYPH     60
FTFRFILDND PQDERISNLP THGPLAGMRI PIINEHGADE LRRELELLML ASEEDEEVSC    120
LITDALWYFA QSVADSLNLR RLVLMTSSLF NFHAHVSLPQ FDELGYLDPD DKTRLEEQAS    180
GFPMLKVKDI KSAYSNWQIL KEILGKMIKQ TKASSGVIWN SFKELEESEL ETVIREIPAP    240
SFLIPLPKHL TASSSSLLDH DRTVFQWLDQ QPPSSVLYVS FGSTSEVDEK DFLEIARGLV    300
DSKQSFLWVV RPGFVKGSTW VEPLPDGFLG ERGRIVKWVP QQEVLAHGAI GAFWTHSGWN    360
STLESVCEGV PMIFSDFGLD QPLNARYMSD VLKVGVYLEN GWERGEIANA IRRVMVDEEG    420
EYIRQNARVL KQKADVSLMK GGSSYESLES LVSYISSL                            458

SEQ ID NO: 201
atggctactt ctgattccat cgttgacgat agaaagcaat gcatgttgc tacttttcca      60
tggttggctt tcggtcatat tttgccatac ttgcaattgt ccaagttgat tgctgaaaag    120
ggtcacaagg tttcattctt gtctaccacc agaaacatcc aaagattgtc ctctcatatc    180
tccccattga tcaacgttgt tcaattgact ttgccaagag tccaagaatt gccagaagat    240
gctgaagcta ctactgatgt tcatccgaaa gatatcccctt acttgaaaaa ggcttccgat    300
ggtttacaac cagaagttac tagattcttg aacaacattg cccagattg gatcatctca    360
gattatactc attactggtt gccatccatt gctgcttcat tgggtatttc tagagcccat    420
ttctctgtta ctactccatg ggctattgct tatatgggtc catctgctga tgctatgatt    480
aacgttctg atggtagaac taccgttgaa gatttgacta ctccaccaa gtggtttcca    540
tttccaacaa aagtctgttg gagaaaacac gatttggcta gattggttcc atacaaagct    600
ccaggtattt ctgatggtta cagaatgggg atggttttga aaggttccga ttgcttgttg    660
```

TABLE 3-continued

Sequences disclosed herein.

```
tctaagtgct atcatgaatt cggtactcaa tggttgcctt tgttggaaac attgcatcaa   720
gttccagttg ttccagtagg tttgttgcca ccagaaattc caggtgacga aaaagacgaa   780
acttgggttt ccatcaaaaa gtggttggat ggtaagcaaa agggttctgt tgtttatgtt   840
gctttggggtt ccgaagcttt ggtttctcaa accgaagttg ttgaattggc tttgggtttg   900
gaattgtctg gtttgccatt tgtttgggct tacagaaaac ctaaaggtcc agctaagtct   960
gattctgttg aattgccaga tggtttcgtt gaaagaacta gagatagagg tttggtttgg  1020
acttcttggg ctccacaatt gagaattttg tctcatgaat ccgtctgtgg ttttcttgact  1080
cattgtggtt ctggttctat cgttgaaggt ttgatgtttg gtcacccatt gattatgttg  1140
ccaatctttg gtgaccaacc attgaacgct agattattgg aagataagca agtcggtatc  1200
gaaatcccaa gaaatgaaga agatggttgc ttgaccaaag aatctgttgc tagatctttg  1260
agatccgttg tcgttgaaaa agaaggtgaa atctacaagg ctaacgctag agaattgtcc  1320
aagatctaca acgataccaa ggtcgaaaaa gaatacgttt cccaattcgt tgactacttg  1380
gaaaagaatg ctagagctgt tgccattgat catgaatctt ga                      1422

SEQ ID NO: 202
MATSDSIVDD RKQLHVATFP WLAFGHILPY LQLSKLIAEK GHKVSFLSTT RNIQRLSSHI    60
SPLINVVQLT LPRVQELPED AEATTDVHPE DIPYLKKASD GLQPEVTRFL EQHSPDWIIY   120
DYTHYWLPSI AASLGISRAH FSVTTPWAIA YMGPSADAMI NGSDGRTTVE DLTTPPKWFP   180
FPTKVCWRKH DLARLVPYKA PGISDGYRMG MVLKGSDCLL SKCYHEFGTQ WLPLLETLHQ   240
VPVVPVGLLP PEIPGDEKDE TWVSIKKWLD GKQKGSVVYV ALGSEALVSQ TEVVELALGL   300
ELSGLPFVWA YRKPKGPAKS DSVELPDGFV ERTRDRGLVW TSWAPQLRIL SHESVCGFLT   360
HCGSGSIVEG LMFGHPLIML PIFGDQPLNA RLLEDKQVGI EIPRNEEDGC LTKESVARSL   420
RSVVVEKEGE IYKANARELS KIYNDTKVEK EYVSQFVDYL EKNARAVAID HES          473

SEQ ID NO: 203
atggatagtg gctactcctc atcttatgct gctgccgctg gtatgcacgt tgtgatctgc    60
ccttggttg cctttggtca cctgttacca tgtctggatt tagcccaaag actggcctca   120
agaggccata gagtatcatt tgtgtctact cctagaaata tctctcgttt accaccagtc   180
agacctgctc tagctcctct agttgcattc gttgctcttc cacttccaag agtagaagga   240
tgccagacg cgctgaatc tactaatgac gtaccacatg atagacctga catggtcgaa   300
ttgcatagaa gagcctttga tggattggca gctccatttt ctgagttcct gggcacagca   360
tgtgcagact gggtatagt cgatgtattt catcactggg ctgctgcagc cgcattggaa   420
cataaggtgc cttgtgctat gatgttgtta gggtcagcac acatgatcgc atccatagct   480
gatagaagat tggaaagagc tgaaacagaa tccccagccg cagcaggaca aggtaggcca   540
gctgccgccc caacctttga agtggctaga atgaaattga ttcgtactaa aggtagttca   600
gggatgagtc ttgctgaaag gttttctctg acattatcta gatcatcatt agttgtaggt   660
agatcctgcg tcgagttcga acctgaaaca gtacctttac tatctacttt gagaggcaaa   720
cctattactt tccttggtct aatgcctcca ttacatgaag gaaggagaga agatggtgaa   780
gatgctactg ttaggtggtt agatgcccaa cctgctaagt ctgttgttta cgttgcattg   840
ggttctgagg taccactagg ggtggaaaag gtgcatgaat tagcattagg acttgagctg   900
gccggaacaa gattcctttg ggctttgaga aaaccaaccg gtgtttctga cgccgacttg   960
ctaccagctg ggttcgaaga gaaacaaga ggccgtggtg tcgttgctac tagatgggtc  1020
ccacaaatga gtattctagc tcatgcagct gtaggggcct tctaaccca ttgcggttgg  1080
aactcaacaa tagaaggact ggtgtttggt catccactta ttatgttacc aatctttgg   1140
gatcagggac ctaacgcaag attgattgag gcaaagaacg caggtctgca ggttgcacgt  1200
aatgatggtg atggttcctt tgatagaaa ggcgttgcag ctgccatcag agcagtcgcc  1260
gttgaggaag agtcatctaa agttttccaa gctaaggcca aaaaattaca agagattgtg  1320
gctgacatgg cttgtcacga aagatacatc gatggtttca tccaacaatt gagaagttat  1380
aaagactaa                                                            1389

SEQ ID NO: 204
MDSGYSSSYA AAAGMHVVIC PWLAFGHLLP CLDLAQRLAS RGHRVSFVST PRNISRLPPV    60
RPALAPLVAF VALPLPRVEG LPDGAESTND VPHDRPDMVE LHRRAFDGLA APFSEFLGTA   120
CADWVIVDVF HHWAAAAALE HKVPCAMMLL GSAHMIASIA DRRLERAETE SPAAAGQGRP   180
AAAPTFEVAR MKLIRTKGSS GMSLAERFSL TLSRSSLVVG RSCVEFEPET VPLLSTLRGK   240
PITFLGLMPP LHEGRREDGE DATVRWLDAQ PAKSVVYYAL GSEVPLGVEK VHELALGLEL   300
AGTRFLWALR KPTGVSDADL LPAGFEERTR GRGVVATRWV PQMSILAHAA VGAFLTHCGW   360
NSTIEGLMFG HPLIMLPIFG DQGPNARLIE AKNAGLQVAR NDGDGSFDRE GVAAAIRAVA   420
VEEESSKVFQ AKAKKLQEIV ADMACHERYI DGFIQQLRSY KD                      462

SEQ ID NO: 205
atggctacct tgttggaaca ttttcaagct atgccattcg ctattccaat tgctttggct    60
gctttgtctt ggttgttttt gttctacatc aaggttctt tcttctccaa caaatccgct   120
caagctaaat tgccaccagt tccagttgtt ccaggttgc cagttattgg taatttgttg   180
caattgaaag aaaagaagcc ataccaaacc ttcactagat gggctgaaga atatgtccca   240
atctactcta ttagaactgg tgcttctact atggttgtct tgaacactac tcaagttgcc   300
aaagaagcta tggttaccag atacttgtct atctctacca gaaagttgtc caacgccttg   360
aaaattttga ccgctgataa gtgcatggtt gccatttctg attacaacga tttccacaag   420
atgatcaaga gatatatctt gtctaacgtt ttgggtccat ctgcccaaaa aagacataga   480
tctaacagag ataccttgag agccaacgtt tgttctagat tgcattccca agttaagaac   540
tctccaagag aagctgtcaa ctttagaaga gttttcgaat gggaattatt cggtatcgct   600
ttgaaacaag ccttcggtaa ggatattgaa agccaatct cgtcgaaga attgggtact   660
acttctgcca gagatgaaat cttcaaggtt ttggtcttgg acattatgga aggtgccatt   720
gaagttgatt ggagagattt ttttcccatac ttgcgttgga ttccaaacac cagaatggaa   780
actaagatcc aaagattata ctttagaaga aaggccgtta tgaccgcctt gattaacgaa   840
caaaagaaaa gaattgcctc cggtgaagaa atcaactgct acatcgattt cttgttgaaa   900
gaaggtaaga cccttgaccat ggaccaaatc tctatgttgt tgtgggaaac cgttattgaa   960
actgctgata ccacaatggt tactactgaa tgggctatgt acgaagttgc taaggattct  1020
```

TABLE 3-continued

Sequences disclosed herein.

```
aaaagacaag acagattata ccaagaaatc caaaaggtct gcggttctga aatggttaca   1080
gaagaatact tgtcccaatt gccatacttg aatgctgttt tccacgaaac tttgagaaaa   1140
cattctccag ctgctttggt tccattgtga tatgctcatg aagatactca attgggtggt   1200
tattacattc cagccggtac tgaaattgcc attaacatct acggttgcaa catggacaaa   1260
caccaatggg aatctccaga agaatggaag ccagaaagat ttttggatcc taagtttgac   1320
ccaatggact tgtacaaaac tatggctttt ggtgctggta aaagagtttg cgctggttct   1380
ttacaagcta tgttgattgc ttgtccaacc atcggtagat tggttcaaga atttgaatgg   1440
aagttgagag atggtgaaga agaaaacgtt gatactgttg gtttgaccac ccataagaga   1500
tatccaatgc atgctatttt gaagccaaga tcttaa                             1536

SEQ ID NO: 206
MATLLEHFQA MPFAIPIALA ALSWLFLFYI KVSFFSNKSA QAKLPPVPVV PGLPVIGNLL    60
QLKEKKPYQT FTRWAEEYGP IYSIRTGAST MVVLNTTQVA KEAMVTRYLS ISTRKLSNAL   120
KILTADKCMV AISDYNDFHK MIKRYILSNV LGPSAQKRHR SNRDTLRANV CSRLHSQVKN   180
SPREAVNFRR VFEWELFGIA LKQAFGKDIE KPIYVEELGT TLSRDEIFKV LVLDIMEGAI   240
EVDWRDFFPY LRWIPNTRME TKIQRLYFRR KAVMTALINE QKKRIASGEE INCYIDFLLK   300
EGKTLTMDQI SMLLWETVIE TADTTMVTTE WAMYEVAKDS KRQDRLYQEI QKVCGSEMVT   360
EEYLSQLPYL NAVFHETLRK HSPAALVPLR YAHEDTQLGG YYIPAGTEIA INIYGCNMDK   420
HQWESPEEWK PERFLDPKFD PMDLYKTMAF GAGKRVCAGS LQAMLIACPT IGRLVQEFEW   480
KLRDGEEENV DTVGLTTHKR YPMHAILKPR S                                 511

SEQ ID NO: 207
atggctttgg taaacccaac cgctctttc tatggtaccct ctatcagaac aagacctaca    60
aacttactaa atccaactca aaagctaaga ccagtttcat catcttcctt accttctttc   120
tcatcagtta gtgcgattct tactgaaaaa catcaatcta atccttctga gaacaacaat   180
ttgcaaactc atctagaaac tccttttcaac tttgatagtt atatgttgga aaaagtcaac   240
atggttaacg aggcgcttga tgcatctgtc ccactaaaag acccaatcaa aatccatgaa   300
tccatgagat actcttatt ggcaggcggt aagagaatca gaccaatgat gtgtattgca   360
gcctgcgaaa tagtcggagg taatatcctt aacgccatgc cagccgcatg tgccgtggaa   420
atgattcata ctatgtcttt ggtgcatgac gatcttccat gtatggataa tgatgacttc   480
agaagaggta aacctatttc acacaaggtc tacggggagg aaatggcagt attgaccggc   540
gatgctttac taagtttatc tttcgaacat atagctacgt ctacaaaggg tgtatcaaag   600
gatagaatcg tcagagctat aggggagttg gcccgttcag ttggctccga aggtttagtg   660
gctgacaag ttgtagatat cttgtcagag ggtgctgatg ttggattaga tcacctagaa   720
tacattcaca tccacaaaac agcaatgttg cttgagtcct cagtagttat tggcgctatc   780
atgggaggag gatctgatca gcagatcgaa aagttgaaga aattcgctag atctcattgg   840
ctactattcc aagttgtgga tgacattttg gatgttacaa aatctaccga agagttgggg   900
aaaacagctg gtaaggattt gttgacagat aagacaactt acccaaagtt gttaggtata   960
gaaaagtcca gagaatttgc cgaaaaactt aacaaggaag cacaagagca attaagtggc  1020
tttgatagac gtaaggcagc tcctttgatc gcgttagcca actacaatgc gtaccgtcaa  1080
aattga                                                            1086

SEQ ID NO: 208
MALVNPTALF YGTSIRTRPT NLLNPTQKLR PVSSSSLPSF SSVSAILTEK HQSNPSENNN    60
LQTHLETPFN FDSYMLEKVN MVNEALDASV PLKDPIKIHE SMRYSLLAGG KRIRPMMCIA   120
ACEIVGGNIL NAMPAACAVE MIHTMSLVHD DLPCMDNDDF RRGKPISHKV YGEEMAVLTG   180
DALLSLSFEH IATATKGVSK DRIVRAIGEL ARSVGSEGLV AGQVVDILSE GADVGLDHLE   240
YIHIHKTAML LESSVVIGAI MGGGSDQQIE KLRKFARSIG LLFQVVDDIL DVTKSTEELG   300
KTAGKDLLTD KTTYPKLLGI EKSREFAEKL NKEAQEQLSG FDRRKAAPLI ALANYNAYRQ   360
N                                                                 361

SEQ ID NO: 209
atggctgagc aacaaatatc taacttgctg tctatgtttg atgcttcaca tgctagtcag    60
aaattagaaa ttactgtcca atgatggac acataccatt acagagaaac gcctccagat   120
tcctcatctt ctgaaggcgg ttcattgtct agatacgacg agagaagagt ctctttgcct   180
ctcagtcata atgctgcctc tccagatatt gtatcacaac tatgtttttc cactgcaatg   240
tcttcagagt tgaatcacag atggaaatct caaagattaa aggtggccga ttctccttac   300
aactatatcc taacattacc atcaaaagga attagaggtg cctttatcga ttccctgaac   360
gtatggttgg aggttccaga ggatgaaaca tcagtcatca aggaagttat tggtatgctc   420
cacaactctc tcattaatca tgatgacttc aagataatt ctccacttag aagaggaaag   480
ccatctaccc atacagtctt cggccctgcc caggctatca atactgctac ttacgttata   540
gttaaagcaa tcgaaaagat acaagacata gtgggacaca atgcattggc agatgttacg   600
ggtactatta caactatttt ccaaggtcag gccatggact gtggtggac agcaaatgca   660
atcgttccat caatacagga aacttactt atggtaaacg ataaaaccgg tgctctcttt   720
agactgagtt tggagttgtt agctctgaat tccgaagcca gtatttctga tctctgcttta   780
gaaagtttat ctagtgctgt ttccttgcta ggtcaatact tccaaatcag agacgactat   840
atgaacttga tcgataacaa gtatacagat cagaaaggct tctgcgaaga tcttgatgaa   900
ggcaagtact cactaaacact tattcatgcc ctccaaactg attcatccga tctactgacc   960
aacatccttt caatgagaag agtgcaagga agttaacgg cacaaagag atgttggttc  1020
tggaaatga                                                         1029

SEQ ID NO: 210
MAEQQISNLL SMFDASHASQ KLEITVQMMD TYHYRETPPD SSSEGGSLS RYDERRVSLP    60
LSHNAASPDI VSQLCFSTAM SSELNHRWKS QRLKVADSPY NYILTLPSKG IRGAFIDSLN   120
VWLEVPEDET SVIKEVIGML HNSSLIIDDF QDNSPLRRGK PSTHTVFGPA QAINTATYVI   180
VKAIEKIQDI VGHDALADVT GTITTIFQGQ AMDLWWTANA IVPSIQEYLL MVNDKTGALF   240
RLSLELLALN SEASISDSAL ESLSSAVSLL GQYFQIRDDY MNLIDNKYTD QKGFCEDLDE   300
GKYSLTLIHA LQTDSSDLLT NILSMRRVQG KLTAQKRCWF WK                     342
```

TABLE 3-continued

Sequences disclosed herein.

```
SEQ ID NO: 211
atggaaaaga ctaaggagaa agcagaacgt atcttgctgg agccatacag atacttatta    60
caactaccag gaaagcaagt ccgttctaaa ctatcacaag cgttcaatca ctggttaaaa   120
gttcctgaag ataagttaca aatcattatt gaagtcacag aaatgctaca caatgcttct   180
ttactgatcg atgatataga ggattcttcc aaactgagaa gaggttttcc tgtcgctcat   240
tccatatacg gggtaccaag tgtaatcaac tcagctaatt acgtctactt cttgggattg   300
gaaaaagtat tgacattaga tcatccagac gctgtaaagc tattcaccag acaacttctt   360
gaattgcatc aaggtcaagg tttggatatc tattggagag acacttatac ttgcccaaca   420
gaagaggagt acaaagcaat ggttctacaa aagactggcg gtttgttcgg acttgccgtt   480
ggtctgatgc aacttttctc tgattacaag gaggacttaa agcctctgtt ggataccttg   540
ggcttgtttt tccagattag agatgactac gctaacttac attcaaagga atattcagaa   600
aacaaatcat tctgtgaaga tttgactgaa gggaagttta gttttccaac aatccacgcc   660
atttggtcaa gaccagaatc tactcaagtg caaaacattc tgcgtcagag aacagagaat   720
attgacatca aaaagtattg tgttcagtac ttggaagatg ttggttcttt tgcttacaca   780
agacatacac ttagagaatt agaggcaaaa gcataaaagc aaatagaagc ctgtggaggc   840
aatccttctc tagtggcatt ggttaaacat ttgtccaaaa tgttcaccga ggaaaacaag   900
taa                                                                 903

SEQ ID NO: 212
MEKTKEKAER ILLEPYRYLL QLPGKQVRSK LSQAFNHWLK VPEDKLQIII EVTEMLHNAS    60
LLIDDIEDSS KLRRGFPVAH SIYGVPSVIN SANYVYFLGL EKVLTLDHPD AVKLFTRQLL   120
ELHQGQGLDI YWRDTYTCPT EEEYKAMVLQ KTGGLFGLAV GLMQLFSDYK EDLKPLLDTL   180
GLFFQIRDDY ANLHSKEYSE NKSFCEDLTE GKFSFPTIHA IWSRPESTQV QNILRQRTEN   240
IDIKKYCVQY LEDVGSFAYT RHTLRELEAK AYKQIEACGG NPSLVALVKH LSKMFTEENK   300

SEQ ID NO: 213
atggcaagat tctattttct taacgcacta ttgatggtta tctcattaca atcaactaca    60
gccttcactc cagctaaact tgcttatcca acaacaacaa cagctctaaa tgtcgcctcc   120
gccgaaactt ctttcagtct agatgaatac ttggcctcta gataggacc tatagagtct   180
gccttggaag catcagtcaa atccagaatt ccacagaccg ataagatctg cgaatctatg   240
gcctactctt tgatggcagg aggcaagaga attagaccag tgttgtgtat cgctgcatgt   300
gagatgttcg gtggatccca agatgtcgct atgcctactg ctgtggcatt agaaaatgata   360
cacacaatgt ctttgattca tgatgatttg ccatccatgg ataacgatga cttgagaaga   420
ggtaaaccaa caaaccatgt cgttttcggc gaagatgtag ctattcttgc aggtgactct   480
ttattgtcaa cttccttcga gcacgtcgct agagaaacaa aaggagtgtc agcagaaaag   540
atcgtggatg ttatcgctag attaggcaaa tctgttggtg ccgagggcct tgctggcggt   600
caagttatgg acttagaatg tgaagctaaa ccaggtacca cattagacga cttgaaatgg   660
attcatatcc ataaaaccgc tacattgtta caagttgctg tagcttctgg tgcagttcta   720
ggtggtgcaa ctcctgaaga ggttgctgca tgcgagttgt ttgctatgaa tataggtctt   780
gcctttcaag ttgccgacga tatccttgat gtaaccgctt catcagaaga tttgggtaaa   840
actgcaggca agatgaagc tactgataag acaacttacc caaagttatt aggattagaa   900
gagagtaagg catacgcaag acaactaatc gatgaagcca ggaaagttt ggctcctttt   960
ggagatagag ctgcccctt ttattggcatt gcagatttca ttattgatag aaagaattga  1020

SEQ ID NO: 214
MARFYFLNAL LMVISLQSTT AFTPAKLAYP TTTTALNVAS AETSFSLDEY LASKIGPIES    60
ALEASVKSRI PQTDKICESM AYSLMAGGKR IRPVLCIAAC EMFGGSQDVA MPTAVALEMI   120
HTMSLIHDDL PSMDNDDLRR GKPTNHVVFG EDVAILAGDS LLSTSFEHVA RETKGVSAEK   180
IVDVIARLGK SVGAEGLAGG QVMDLECEAK PGTTLDDLKW IHIHKTATLL QVAVASGAVL   240
GGATPEEVAA CELFAMNIGL AFQVADDILD VTASSEDLGK TAGKDEATDK TTYPKLLGLE   300
ESKAYARQLI DEAKESLAPF GDRAAPLLAI ADFIIDRKN                          339

SEQ ID NO: 215
atgcacttag caccacgtag agtccctaga ggtagaagat caccacctga cagagttcct    60
gaaagacaag gtgccttggg tagaagacgt ggagctggct ctactggctg tgcccgtgct   120
gctgctggtg ttcaccgtag aagaggagga ggcgaggctg atccatcagc tgctgtgcat   180
agaggctggc aagccggtgg tggcaccggt ttgcctgatg aggtggtgtc taccgcagcc   240
gccttagaaa tgtttcatgc ttttgcttta atccatgatg atatcatgga tgatagtgca   300
actagaagag gctccccaac tgttcacaga gccctagctg atcgtttagg cgctgctctg   360
gacccagatc aggccggtca actaggagtt tctactgcta tcttggttgg agatctggat   420
ttgacatggt ccgatgaatt gttatacgct ccattgactc cacatagact ggcagcagta   480
ctaccattgg taacagctat gagagctgaa accgttcatg gccaatatct tgatataact   540
agtgctagaa gacctgggac cgatacttct cttgcattga atagccag atataagaca   600
gcagcttaca caatgaacg tccactgcac atggtgcag ccctggctgg agcaagacca   660
gaactattag cagggctttc agcatacgcc ttgccagctg gagaagcctt ccaattggca   720
gatgacctgc taggcgtctt cggtgatcca agacgtacag ggaaacctga cctagatgat   780
cttagaggtg gaaagcatac tgtcttagtc gccttggcaa gagaacatgc cactccagaa   840
cagagacaca cattggatac attattgggt acaccaggtc ttgatagaca aggcgcttca   900
agactaagat gcgtattggt agcaactggt gcaagagccg aagccgaaag acttattaca   960
gagagaagag atcaagcatt aactgcattg aacgcattaa cactgccacc tccttagct  1020
gaggcattag caagattgac attagggtct acagctcatc ctgcctaa              1068

SEQ ID NO: 216
MHLAPRRVPR GRRSPPDRVP ERQGALGRRR GAGSTGCARA AAGVHRRRGG GEADPSAAVH    60
RGWQAGGGTG LPDEVVSTAA ALEMFHAFAL IHDDIMDDSA TRRGSPTVHR ALADRLGAAL   120
DPDQAGQLGV STAILVGDLA LTWSDELLYA PLTPHRLAAV LPLVTAMRAE TVHGQYLDIT   180
SARRPGTDTS LALRIARYKT AAYTMERPLH IGAALAGARP ELLAGLSAYA LPAGEAFQLA   240
```

TABLE 3-continued

Sequences disclosed herein.

```
          DDLLGVFGDP RRTGKPDLDD LRGGKHTVLV ALAREHATPE QRHTLDTLLG TPGLDRQGAS    300
          RLRCVLVATG ARAEAERLIT ERRDQALTAL NALTLPPPLA EALARLTLGS TAHPA         355

SEQ ID NO: 217
          atgtcatatt tcgataacta cttcaatgag atagttaatt ccgtgaacga catcattaag     60
          tcttacatct ctggcgacgt accaaaacta tacgaagcct cctaccattt gtttacatca    120
          ggaggaaaga gactaagacc attgatcctt acaatttctt ctgatctttt cggtggacag    180
          agagaaagag catactatgc tggcgcagca atcgaagttt gcacacatt cactttggtt    240
          cacgatgata tcatggatca agataacatt cgtagaggtc ttcctactgt acatgtcaag    300
          tatggcctac ctttggccat tttagctggt gacttattgc atgcaaaagc cttcaattg    360
          ttgactcagg cattgagagg tctaccatct gaaactatca tcaaggcgtt tgatatcttt    420
          acaagatcta tcattatcat atcagaaggt caagctgtcg atatggaatt cgaagataga    480
          attgatatca aggaacaaga gtatttggat atgatatctc gtaaaaccgc tgccttattc    540
          tcagcttctt cttccattgg ggcgttgata gctggagcta atgataacga tgtgagatta    600
          atgtccgatt tcggtacaaa tcttgggatc gcatttcaaa ttgtagatga tatacttggt    660
          ttaacagctg atgaaaaaga gctaggaaaa cctgttttca gtgatatcag agaaggtaaa    720
          aagaccatat tagtcattaa gactttagaa ttgtgtaagg aagacgagaa aaagattgtg    780
          ttaaaagcgc taggcaacaa gtcagcatca aggaagagt tgatgagttc tgctgacata    840
          atcaaaaagt actcattgga ttacgcctac aacttagctg agaaatacta caaaaacgcc    900
          atcgattctc taaatcaagt ttcaagtaaa agtgatattc cagggaaggc attgaaatat    960
          cttgctgaat tcaccatcag aagacgtaag taa                                  993

SEQ ID NO: 218
          MSYFDNYFNE IVNSVNDIIK SYISGDVPKL YEASYHLFTS GGKRLRPLIL TISSDLFGGQ     60
          RERAYYAGAA IEVLHTFTLV HDDIMDQDNI RRGLPTVHVK YGLPLAILAG DLLHAKAFQL    120
          LTQALRGLPS ETIIKAFDIF TRSIIIISEG QAVDMEFEDR IDIKEQEYLD MISRKTAALF    180
          SASSSIGALI AGANDNDVRL MSDFGTNLGI AFQIVDDILG LTADEKELGK PVFSDIREGK    240
          KTILVIKTLE LCKEDEKKIV LKALGNKSAS KEELMSSADI IKKYSLDYAY NLAEKYYKNA    300
          IDSLNQVSSK SDIPGKALKY LAEFTIRRRK                                     330

SEQ ID NO: 219
          atggcctctg ttactttggg ttcctggatc gtcgtccacc accataacca tcaccatcca     60
          tcatctatcc taactaaatc tcgttcaaga tcctgtccta ttacactaac caaaccaatc    120
          tctttcgtt caaagagaac agtttcctct agtagttcta tcgtgtcctc tagtgtcgtc    180
          actaaggaag acaatctgag acagtctgaa ccttcttcct ttgatttcat gtcatatatc    240
          attactaagg cagaactagt gaataaggct cttgattcag cagttccatt aagagagcca    300
          ttgaaaatcc atgaagcaat gagatactct cttctagctg gcgggaagag agtcagacct    360
          gtactctgca tagcagcgtg cgaattagtt ggtggcgagg aatcaaccgc tatgcctgcc    420
          gcttgtgctg tagaaatgat tcatacaatg tcactgatac acgatgattt gccatgtatg    480
          gataacgatg atctgagaag gggtaagcca actaaccata ggtttttcgg cgaagatgtt    540
          gccgtcttag ctggtgatgc tttgttatct ttcgcgttcg aacatttggc atccgcaaca    600
          tcaagtgatg ttgtgtcacc agtaagagta gttagagcag ttggagaact ggctaaagct    660
          attggaactg agggtttagt tgcaggtcaa gtcgtcgata tctcttccga aggtcttgat    720
          ttgaatgatg taggtcttga acatctcgaa ttcatccatc ttcacaagac agctgcactt    780
          ttagaagcca gtgcggttct cggcgcaatt gttggcggag ggagtgatga cgaaattgag    840
          agattgagga agtttgctag atgtataggg ttactgttcc aagtagtaga cgatatacta    900
          gatgtgacaa agtcttccaa agagttggga aaaacagctg gtaaagattt gattgccgac    960
          aaattgacct acccctaagat tatggggcta gaaaaatcaa gagaatttgc cgagaaactc   1020
          aatagagagg cgcgtgatca actgttgggt ttcgattctg ataaagttgc caccactctta   1080
          gccttagcca actacatcgc ttacagacaa aactaa                             1116

SEQ ID NO: 220
          MASVTLGSWI VVHHNHHHP SSILTKSRSR SCPITLTKPI SFRSKRTVSS SSIVSSSVV      60
          TKEDNLRQSE PSSFDFMSYI ITKAELVNKA LDSAVPLREP LKIHEAMRYS LLAGGKRVRP    120
          VLCIAACELV GGEESTAMPA ACAVEMIHTM SLIHDDLPCM DNDDLRRGKP TNHKVFGEDV    180
          AVLAGDALLS FAFEHLASAT SSDVVSPVRV VRAVGELAKA IGTEGLVAGQ VVDISSEGLD    240
          LNDVGLEHLE FIHLHKTAAL LEASAVLGAI VGGGSDDEIE RLRKFARCIG LLFQVVDDIL    300
          DVTKSSKELG KTAGKDLIAD KLTYPKIMGL EKSREFAEKL NREARDQLLG FDSDKVAPLL    360
          ALANYIAYRQ N                                                        371

SEQ ID NO: 221
          atgaaaaccg gtttatctc accagcaaca gtatttcatc acagaatctc accagcgacc     60
          actttcagac atcacttatc acctgctact acaaactcta caggcattgt cgccttaaga    120
          gacatcaact tcagatgtaa agcagtttct aaagagtact ctgatctgtt gcagaaagat    180
          gaggcttctt tcacaaaatg gacgatgac aaggtagaag atcatcttga taccaacaaa    240
          aacttatacc caaatgatga gattaaggaa tttgttgaat cagtaaaggc tatgttcggt    300
          agtatgaatg acgggagat aaacgtctct gcatacgata ctgcatgggt tgcttttggtt    360
          caagatgtcg atggatcagg tagtcctcag ttccctttctt ctttagaatg gattgccaac    420
          aatcaattgt cagatggatc atgggagat catttgtgt tctcagctca cgatagaatc    480
          atcaacacat tagcatgcgt tattgcactt acaagttgga atgttcatcc ttctaagtgt    540
          gaaaaggttt tgaattttct gagagaaaac atttgcaaat tagaagatga aaacgcagaa    600
          catatgccaa ttggttttga agtaacattc ccatcactaa ttgatatcgc gaaaaagttg    660
          aacattgaag tacctgagga tactccagca cttaaagaga tctacgacgt tagagatatc    720
          aagttaacta agatcccaat ggaagttctt cacaaggtac ctactacttt gttacattct    780
          ttggaaggaa tgcctgattt ggagtgggaa aaactgttaa agctacaatg taaagatggt    840
          agtttccttgt tttcccccatc tagtaccgca ttcgccctaa tgcaaacaaa agatgagaaa    900
          tgcttacagt atctaacaaa tatcgtcact aagttcaacg gtggcgtgcc taatgtgtac    960
          ccagtcgatt tgttgaaca tatttgggtt gttgatagac tgcagagatt ggggattgcc   1020
```

TABLE 3-continued

Sequences disclosed herein.

```
agatacttca aatcagagat aaaagattgt gtagagtata tcaataagta ctggaccaaa   1080
aatggaattt gttgggctag aaatactcac gttcaagata tcgatgatac agccatggga   1140
ttcagagtgt tgagagcgca cggttatgac gtcactccag atgttttag acaatttgaa    1200
aaagatggta aattcgtttg ctttgcaggg caatcaacac aagccgtgac aggaatgttt   1260
aacgtttaca gagcctctca aatgttgttc ccaggggaga gaatttttgga agatgccaaa  1320
aagttctctt acaattactt aaaggaaaag caaagtacca acgaattgct ggataaatgg   1380
ataatcgcta aagatctacc tggtgaagtt ggttatgctc tggatatccc atggtatgct   1440
tccttaccaa gattggaaac tcgttattac cttgaacaat acggcggtga agatgatgtc   1500
tggataggca agacattata cagaatgggt tacgtgtcca ataacacata tctagaaatg   1560
gcaaagctgg attacaataa ctatgttgca gtccttcaat tagaatggta cacaatacaa   1620
caatggtacg tcgatattgg tatagagaag ttcgaatctg acaacatcaa gtcagtcctg   1680
gtttcttact acttggctgc ggcttcaata ttcgaacctg agatctaa ggagagaatc     1740
gcttgggcaa agacaacaat cttagtcgat aagatcacat caattttcga ttcctctcag  1800
tcaagtaagg aagatattac tgcctttatt gacaagtttc gtaacaagtc ctcctctaaa   1860
aagcactcta tcaacggtga accatggcat gaagttatgg tagctttgaa aaagaccttaa  1920
cacggctttg ctctggatgc tcttatgact cattctcaag atatacatcc acagttacat   1980
caagcctggg aaatgtggtt gactaaacta caagacggcg tagatgttac tgctgagcta   2040
atggtccaaa tgatcaacat gactgctggc agatgggtat caaggaatt acttactcat    2100
ccacaatatc aaagattgtc tactgtgaca aattctgtgt gtcacgatat taccaaactt   2160
cacaatttca aggagaattc caccacagtg gattcaaagg ttcaggaact agtccagttg   2220
gttttagtg acacaccaga tgatttggat caagatatga aacaaacatt cctgacagtg     2280
atgaagacat tctactacaa ggcgtggtgt gatccaaaca ctataaacga tcatatatct   2340
aaagttttcg aaatcgtaat ttga                                          2364

SEQ ID NO: 222
MKTGFISPAT VFHHRISPAT TFRHHLSPAT TNSTGIVALR DINFRCKAVS KEYSDLLQKD     60
EASFTKWDDD KVKDHLDTNK NLYPNDEIKE FVESVKAMFG SMNDGEINVS AYDTAWVALV   120
QDVDGSGSPQ FPSSLEWIAN NQLSDGSWGD HLLFSAHDRI INTLACVIAL TSWNVHPSKC   180
EKGLNFLREN ICKLEDENAE HMPIGFEVTF PSLIDIAKKL NIEVPEDTPA LKEIYARRDI   240
KLTKIPMEVL HKVPTTLLHS LEGMPDLEWE KLLKLQCKDG SFLFSPSSTA FALMQTKDEK   300
CLQYLTNIVT KFNGGVPNVY PVDLFEHIWV VDRLQRLGIA RYFKSEIKDC VEYINKYWTK   360
NGICWARNTH VQDIDDTAMG FRVLRAHGYD VTPDVFRQFE KDGKFVCFAG QSTQAVTGMF   420
NVYRASQMLF PGERILEDAK KFSYNYLKEK QSTNELLDKW IIAKDLPGEV GYALDIPWYA   480
SLPRLETRYY LEQYGGEDDV WIGKTLYRMG YVSNNTYLEM AKLDYNNYVA VLQLEWYTIQ   540
QWYVDIGIEK FESDNIKSVL VSYYLAAASI FEPERSKERI AWAKTTILVD KITSIFDSSQ   600
SSKEDITAFI DKFRNKSSSK KHSINGEPWH EVMVALKKTL HGFALDALMT HSQDIHPQLH   660
QAWEMWLTKL QDGVDVTAEL MVQMINMTAG RWVSKELLTH PQYQRLSTVT NSVCHDITKL   720
HNFKENSTTV DSKVQELVQL VFSDTPDDLD QDMKQTFLTV MKTFYYKAWC DPNTINDHIS   780
KVFEIVI                                                             787

SEQ ID NO: 223
atgcctgatg cacacgatgc tccacctcca caaataagac agagaacact agtagatgag    60
gctacccaac tgctaactga gtccgcagaa gatgcatggg gtgaagtcag tgtgtcagaa   120
tacgaaacag caaggctagt tgcccatgct acatggttag gtggacacgc cacaagagtg   180
gccttccttc tggagagaca acacgaagac gggtcatggg gtccaccagg tggatatagg   240
ttagtcccta cattatctgc tgttcacgca ttattgacat gtcttgcctc tcctgctcag   300
gatcatggcg ttccacatga tagactttta agagctgttg acgcaggctt gactgccttg   360
agaagattgg ggacatctga ctccccacct gatactatag cagttgagct ggttatccca   420
tctttgctag agggcattca cacttactg gaccctgctc atcctcatag tagaccagcc    480
ttctctcaac ataggggctc tcttgttttgt cctggtggac tagatgggag aactctagga   540
gctttgagat cacacgccgc agcaggtaca ccagtaccag gaaaagtctg cacgccttcc   600
gagactttgg gcttgagtac cgaagctgct tctcacttgc aaccagccca aggtataatc   660
ggtggctctg ctgctgccac agcaacatgg ctaaccaggg ttgcaccatc tcaacagtca   720
gattctgcca agatacct tgaggaatta caacacagat actctggccc agttccttcc     780
attaccccta tcacatactt cgaaagagca tggttattga acaattttgc agcagccgat   840
gttccttgtg aggctccagc tgctttgttg gattccttag aagcagcact acaccacaa    900
ggtgctcctg ctggagcagg attgcctcca gatgctgatg atacagccgc tgtgttgctt   960
gcattggcaa cacatgggag aggtagaaga ccagaagtac tgatggatta caggactgac  1020
gggtatttcc aatgctttat tggggaaagg actccatcaa tttcaacaaa cgctcacgta   1080
ttggaaacat taggggcatca tgtggcccaa catccacaag atagagccag atacggatca  1140
gccatggata ccgcatcagc ttggctgctg gcagctcaaa agcaagatgg ctcttggtta   1200
gataaatggc atgcctcacc atactacgct actgtttgtt gcacacaagc cctagccgct   1260
catgcaagtc ctgcaactgc accagctaga cagagagctg tcagatgggt tttagccaca   1320
caaagatccg atgcggttg gggtctatgg cattcaactg ttgaagagac tgcttatgcc   1380
ttacagatct tggcccccac cttctggtgg ggcaatatcc cagtccaaca agcacttact   1440
agaggcagag caagattgtg tggagccttg ccactgactc ctttatggca tgataaggat   1500
ttgtatactc cagtaagagt agtcagagct gccagagctg ctgctctgta cactaccaga   1560
gatctattgt taccaccatt gtaa                                          1584

SEQ ID NO: 224
MPDAHDAPPP QIRQRTLVDE ATQLLTESAE DAWGEVSVSE YETARLVAHA TWLGGHATRV     60
AFLLERQHED GSWGPPGGYR LVPTLSAVHA LLTCLASPAQ DHGVPHDRLL RAVDAGLTAL   120
RRLGTSDSPP DTIAVELVIP SLLEGIQHLL DPAHPHSRPA FSQHRGSLVC PGGLDGRTLG   180
ALRSHAAAGT PVPGKVWHAS ETLGLSTEAA SHLQPAQGII GGSAAATATW LTRVAPSQQS   240
DSARRYLEEL QHRYSGPVPS ITPITYFERA WLLNNFAAAG VPCEAPAALL DSLEAALTPQ   300
GAPAGAGLPP DADDTAAVLL ALATHGRGRR PEVLMDYRTD GYFQCFIGER TPSISTNAHV   360
```

TABLE 3-continued

Sequences disclosed herein.

| | | | | | |
|---|---|---|---|---|---|
| LETLGHHVAQ | HPQDRARYGS | AMDTASAWLL | AAQKQDGSWL | DKWHASPYYA | TVCCTQALAA | 420 |
| HASPATAPAR | QRAVRWVLAT | QRSDGWGLW | HSTVEETAYA | LQILAPPSGG | GNIPVQQALT | 480 |
| RGRARLCGAL | PLTPLWHDKD | LYTPVRVVRA | ARAAALYTTR | DLLLPPL | | 527 |

SEQ ID NO: 225

| | | | | | |
|---|---|---|---|---|---|
| atgaacgccc | tatccgaaca | cattttgtct | gaattgagaa | gattattgtc | tgaaatgagt | 60 |
| gatgcgggat | ctgttggtcc | atctgtgtat | gatacggccc | aggccctaag | attccacggt | 120 |
| aacgtaacag | gtagacaaga | tgcatatgct | tggttgatcg | cccagcaaca | agcagatgga | 180 |
| ggttggggct | ctgccgactt | tccactcttt | agacatgctc | caacatgggc | tgcacttctc | 240 |
| gcattacaaa | gagctgatcc | acttcctggc | gcagcagacg | cagttcagac | cgcaacaaga | 300 |
| ttcttgcaaa | gacaaccaga | tccatacgct | catgccgttc | ctgaggatgc | ccctattggt | 360 |
| gctgaactga | tcttgcctca | gttttgtgga | gaggctgctt | ggttgttggg | aggtgtggcc | 420 |
| ttccctagac | acccagccct | attaccatta | gacaggcct | gtttagtcaa | actgggtgca | 480 |
| gtcgccatgt | tgccttcagg | acacccattg | ctccactcct | gggaggcatg | gggtacttct | 540 |
| ccaacaacag | cctgtccaga | cgatgatggt | tctatagta | tctcaccagc | agctacagcc | 600 |
| gcctggagag | cccaggctgt | gaccagaggc | tcaactcctc | aagtgggcag | agctgacgca | 660 |
| tacttacaaa | tggcttcaag | agcaacgaga | tcaggcatag | aaggagtctt | ccctaatgtt | 720 |
| tggcctataa | acgtattcga | accatgctgg | tcactgtaca | ctctccatct | tgccggtctg | 780 |
| ttcgcccatc | cagcactggc | tgaggctgta | agagttatcg | ttgctcaact | tgaagcaaga | 840 |
| ttgggagtgc | atggcctcgg | accagcttta | cattttgctg | ccgacgctga | tgatactgca | 900 |
| gttgccttat | gcgttctgca | tttggctggc | agagatcctg | cagttgacgc | attgagacat | 960 |
| tttgaaattg | tgagctctt | tgttacattc | ccaggagaga | gaaatgctag | tgtctctacg | 1020 |
| aacattcacg | ctcttcatgc | tttgattg | ttaggtaaga | cgctgccgg | agcaagtgca | 1080 |
| tacgtcgaag | caaatagaaa | tccacatggt | ttgtgggaca | acgaaaaatg | gcacgtttca | 1140 |
| tggctttatc | caactgcaca | cgccgttgca | gctctagctc | aaggcaagcc | tcaatggaga | 1200 |
| gatgaaagag | cactagccgc | tctactacaa | gctcaaagag | atgatggtgg | ttggggagct | 1260 |
| ggtagaggat | ccactttcga | ggaaaccgcc | tacgctcttt | tcgctttaca | cgttatggac | 1320 |
| ggatctgagg | aagccacagg | cagaagaaga | atcgctcaag | tcgtcgcaag | agccttagaa | 1380 |
| tggatgctag | ctagacatgc | cgcacatgga | ttaccacaaa | caccactctg | gattggtaag | 1440 |
| gaattgtact | gtcctactag | agtcgtaaga | gtagctgagc | tagctggcct | gtggttagca | 1500 |
| ttaagatggg | gtagaagagt | attagctgaa | ggtgctggtc | ctgcaccta | a | 1551 |

SEQ ID NO: 226

| | | | | | |
|---|---|---|---|---|---|
| MNALSEHILS | ELRRLLSEMS | DGGSVGPSVY | DTAQALRFHG | NVTGRQDAYA | WLIAQQQADG | 60 |
| GWGSADFPLF | RHAPTWAALL | ALQRADPLPG | AADAVQTATR | FLQRQPDPYA | HAVPEDAPIG | 120 |
| AELILPQFCG | EAAWLLGGVA | FPRHPALLPL | RQACLVKLGA | VAMLPSGHPL | LHSWEAWGTS | 180 |
| PTTACPDDDG | SIGISPAATA | AWRAQAVTRG | STPQVGRADA | YLQMASRATR | SGIEGVFPNV | 240 |
| WPINVFEPCW | SLYTLHLAGL | FAHPALAEAV | RVIVAQLEAR | LGVHGLGPAL | HFAADADDTA | 300 |
| VALCVLHLAG | RDPAVDALRH | FEIGELFVTF | PGERNASVST | NIHALHALRL | LGKPAAGASA | 360 |
| YVEANRNPHG | LWDNEKWHVS | WLYPTAHAVA | ALAQGKPRDH | DERALAALLQ | AQRDDGGWGA | 420 |
| GRGSTFEETA | YALFALHVMD | GSEEATGRRR | IAQVVARALE | WMLARHAAHG | LPQTPLWIGK | 480 |
| ELYCPTRVVR | VAELAGLWLA | LRWGRRVLAE | GAGAAP | | | 516 |

SEQ ID NO: 227

| | | | | | |
|---|---|---|---|---|---|
| atggttttgt | cttcttcttg | tactacagta | ccacacttat | cttcattagc | tgtcgtgcaa | 60 |
| cttggtcctt | ggagcagtag | gattaaaaag | aaaaccgata | ctgttgcagt | accagccgct | 120 |
| gcaggaaggt | ggagaagggc | cttggctaga | gcacagcaca | catcagaatc | cgcagctgtc | 180 |
| gcaaagggca | gcagtttgac | ccctatagtg | agaactgacg | ctgagtcaag | gagaacaaga | 240 |
| tggccaaccg | atgacgatga | cgccgaacct | ttagtggatg | agatcagggc | aatgcttact | 300 |
| tccatgtctg | atggtgacat | ttccgtgagc | gcatacgata | cagcctgggt | cggattggtt | 360 |
| ccaagattag | acgcggtga | aggtcctcaa | ttttccagcag | ctgtgagatg | gataagaaat | 420 |
| aaccagttgc | ctgacggaag | gttgggcgat | gccgcattat | tctctgccta | tgacaggctt | 480 |
| atcaataccc | ttgcctgcgt | tgtaactttg | acaaggtggt | ccctagaacc | agagatgaga | 540 |
| ggtagaggac | tatctttttt | gggtaggaac | atgtggaaat | tagcaactga | agatgaagag | 600 |
| tcaatgccta | ttggcttcga | attagcattt | ccatctttga | tagagcttgc | taagagccta | 660 |
| ggtgtccatg | acttccctta | tgatcaccag | gccctacaag | gaatctactc | ttcaagagag | 720 |
| atcaaaatga | agaggattcc | aaaagaagtg | atgcataccg | ttccaacatc | aattattgcac | 780 |
| agtttggagg | gtatgcctgg | cctagattgg | gctaaactac | ttaaactaca | gagcagcgac | 840 |
| ggaagtttt | tgttctcacc | agctgccact | gcatatgctt | aatgaatac | cggagatgac | 900 |
| aggtgtttta | gctacatcga | tagaacagta | agaaattca | acggcggcgt | ccctaatgtt | 960 |
| tatccagtgg | atctatttga | acatatttgg | gccgttgata | gacttgaaag | attaggaatc | 1020 |
| tccaggtact | tccaaaagga | gatcgaacaa | tgcatgaatt | atgtaaacag | gcattggact | 1080 |
| gaggacggta | tttgttgggc | aaggaactct | gatgtcaaag | aggtggacga | cacagctatg | 1140 |
| gcctttagac | ttcttaggtt | gcacggctac | agcgtcagtc | ctgatgtgtt | taaaaacttc | 1200 |
| gaaaaggacg | gtgaattttt | cgcatttgtc | ggacagtca | atcaagctgt | taccggtatg | 1260 |
| tacaacttaa | acagagcaag | ccagatatcc | ttcccaggcg | aggatgtgct | tcatagagct | 1320 |
| ggtgccttct | catatgagtt | cttgaggaga | aaagaagcag | agggagcttt | gagggacaag | 1380 |
| tggatcattt | ctaaagatct | acctggtgaa | gttgtgtata | ctttgatt | tccatggtac | 1440 |
| ggcaacttac | ctagagtcga | ggccagagac | tacctagagc | aatacggagg | tggtgatgac | 1500 |
| gtttggattg | gcaagacatt | gtataggatg | ccacttgtaa | acaatgatgt | atatttggaa | 1560 |
| ttggcaagaa | tggatttcaa | ccactgccag | gctttgcatc | agttagagtg | gcaaggacta | 1620 |
| aaagatggt | atactgaaaa | taggttgatg | gactttggtc | tcgccaagaa | gatgcccctt | 1680 |
| agagcttatt | ttcttgcagc | tgcatctgtt | tacgagcgtt | gtagagctgc | cgagaggctt | 1740 |
| gcatgggcta | gagccgcaat | actagctaac | gccgtgagca | cccacttaag | aaatagccca | 1800 |
| tcattcagag | aaaggttaga | gcattctctt | aggtgtagac | tagtgaaaga | gacagatggc | 1860 |
| tcctggttta | actcctcaag | tggctctgat | gcagttttag | taaaggctgt | cttaagactt | 1920 |
| actgattcat | tagccaggga | agcacagcca | atccatggag | gtgacccaga | agatattata | 1980 |
| cacaagttgt | taagatctgc | ttgggccgag | tgggttaggg | aaaaggcaga | cgctgccgat | 2040 |

TABLE 3-continued

Sequences disclosed herein.

```
agcgtgtgca atggtagttc tgcagtagaa caagagggat caagaatggt ccatgataaa    2100
cagacctgtc tattattggc tagaatgatc gaaatttctg ccggtagggc agctggtgaa    2160
gcagccagtg aggacggcga tagaagaata attcaattaa caggctccat ctgcgacagt    2220
cttaagcaaa aaatgctagt ttcacaggac cctgaaaaaa atgaagagat gatgtctcac    2280
gtggatgacg aattgaagtt gaggattaga gagttcgttc aatatttgct tagactaggt    2340
gaaaaaaaga ctggatctag cgaaaccagg caaacatttt taagtatagt gaaatcatgt    2400
tactatgctg ctcattgccc acctcatgtc gttgatagac acattagtag agtgattttc    2460
gagccagtaa gtgccgcaaa gtaaccgcgg                                     2490

SEQ ID NO: 228
MVLSSSCTTV PHLSSLAVVQ LGPWSSRIKK KTDTVAVPAA AGRWRRALAR AQHTSESAAV      60
AKGSSLTPIV RTDAESRRTR WPTDDDDAEP LVDEIRAMLT SMSDGDISVS AYDTAWVGLV     120
PRLDGGEGPQ FPAAVRWIRN NQLPDGSWGD AALFSAYDRL INTLACVVTL TRWSLEPEMR     180
GRGLSFLGRN MWKLATEDEE SMPIGFELAF PSLIELAKSL GVHDFPYDHQ ALQGIYSSRE     240
IKMKRIPKEV MHTVPTSILH SLEGMPGLDW AKLLKLQSSD GSFLFSPAAT AYALMNTGDD     300
RCFSYIDRTV KKFNGGVPNV YPVDLFEHIW AVDRLERLGI SRYFQKEIEQ CMDYVNRHWT     360
EDGICWARNS DVKEVDDTAM AFRLLRLHGY SVSPDVFKNF EKDGEFFAFV GQSNQAVTGM     420
YNLNRASQIS FPGEDVLHRA GAFSYEFLRR KEAEGALRDK WIISKDLPGE VVYTLDFPWY     480
GNLPRVEARD YLEQYGGGDD VWIGKTLYRM PLVNNDVYLE LARMDFNHCQ ALHQLEWQGL     540
KRWYTENRLM DFGVAQEDAL RAYFLAAASV YEPCRAAERL AWARAAILAN AVSTHLRNSP     600
SFRERLEHSL RCRPSEETDG SWFNSSSGSD AVLVKAVLRL TDSLAREAQP IHGGDPEDII     660
HKLLRSAWAE WVREKADAAD SVCNGSSAVE QEGSRMVHDK QTCLLLARMI EISAGRAAGE     720
AASEDGDRRI IQLTGSICDS LKQKMLVSQD PEKNEEMMSH VDDELKLRIR EFVQYLLRLG     780
EKKTGSSETR QTFLSIVKSC YYAAHCPPHV VDRHISRVIF EPVSAAK                   827

SEQ ID NO: 229
cttcttcact aaatacttag acagagaaaa cagagctttt taaagccatg tctcttcagt      60
atcatgttct aaactccatt ccaagtacaa ccttttctcag ttctactaaa acaacaatat    120
cttcttcttt cctaccatc tcaggatctc ctctcaatgt cgctagagac aaatccagaa     180
gcggttccat acattgttca aagcttcgaa ctcaagaata cattaattct caagaggttc     240
aacatgattt gcctctaata catgagtggc aacagcttca aggagaagat gctcctcaga     300
ttagtgttgg aagtaatagt aatgcattca aagaagcagt gaagagtgtg aaaacgatct     360
tgagaaacct aacggacggg gaaattacga tatcggctta cgatacagct gggttgcat      420
tgatcgatgc cggagataaa actccggcgt ttccctccgc cgtgaaatgg atcgccgaga     480
accaactttc cgatggttct tggggagatg cgtatctctt ctcttatcat gatcgtctca     540
tcaataccct tgcatgcgtc gttgctcaaa gatcatgsaa tctcttttcct catcaatgca     600
acaaaggaat cacgttttttc cgggaaaata ttgggaagct agaagacgaa aatgatgagc     660
atatgccaat cggattcgaa gtagcattcc catcgttgct tgagatagct cgaggaataa     720
acattgatgt accgtacgat tctccggtct taaaagatat atacgccaag aaagagctaa     780
agcttacaag gataccaaaa gagataatgc acaagatacc aacaacattg ttgcatagtt     840
tggagggggat gcgtgattta gattgggaaa agctcttgaa acttcaatct caagacggat     900
ctttcctctt ctctccttcc tctaccgctt ttgcattcat gcagaccga gacagtaact     960
gcctcgagta tttgcgaaat gccgtcaaac gttcaatgg aggagttccc aatgtctttc    1020
ccgtggatct tttcgagcac atatggatag tggatcgatt acaacgttta gggatatcga    1080
gatactttga agaagagatt aaagagtgtc ttgactatgt ccacagatat tggaccgaca    1140
atggcatatg ttgggctaga tgttcccatg tccaagacat cgatgataca gccatggcat    1200
ttaggctctt aagacaacat ggataccaag tgtccgcaga tgtattcaag aactttgaga    1260
aagaggaga gttttttctgc tttgtggggc aatcaaacca acagtaacc ggtatgttca    1320
acctataccg ggcatcacaa ttggcgtttc caagggaaga gatattgaaa aacgccaaag    1380
agttttctta taattatctg ctagaaaaac gggagagaga ggagttgatt gataagtgga    1440
ttataatgaa agacttacct ggcgagattg ggtttgcgtt agagattcca tggtacgcaa    1500
gcttgcctcg agtagagacg agattctata ttgatcaata tggtggagaa aacgacgttt    1560
ggattggcaa gactctttat aggatgccaa acgtgaacaa taatgatgat ctggaattag    1620
caaaacaaga ttacaacaat tgccaagctc agcatcagct cgaatgggac atattccaaa    1680
agtggtatga agaaaatagg ttaagtgagt gggtgtgcg cagaagtgag cttctcgagt    1740
gttactactt agcggctgca actatatttg aatcagaaag gtcacatgag agaatggttt    1800
gggctaagtc aagtgtattg gttaaagcca tttcttcttc ttttgggaa tcctctgact    1860
ccagaagaag cttctccgat cagtttcatg aatacattgc caatgctcga cgaagtgatc    1920
atcactttaa tgcaggaac atgagattgg accgaccagg atcggttcag gccagtcggc    1980
ttgccggagt gttaatcggg actttgaatc aaatgtcttt tgacctttc atgtctcatg    2040
gccgtgacgt taacaatctc ctctatctat cgtgggaga ttggatggaa aaatggaaac    2100
tatatggaa tgaaggagaa ggagagctca tggtgaagat gataattcta atgaagaaca    2160
atgacctaac taacttcttc acccacactc acttcgttcg tctcgcggaa atcatcaatc    2220
gaatctgtct tcctcgccaa tacttaaagg caaggagaaa cgatgagaag gagaagacaa    2280
taaagagtat ggagaaggag atggggaaaa tggttgagtt agcattgtcg gagagtgaca    2340
catttcgtga cgtcagcatc acgtttcttg atgtagcaaa agcattttac tactttgctt    2400
tatgtggcga tcatctccaa actcacatct ccaaagtctt gtttcaaaaa gtctagtaac    2460
ctcatcatca tcatcgatcc attaacaatc agtggatcga tgtatccata gatgcgtgaa    2520
taatatttca tgtagagaag gagaacaaat tagatcatgt agggttatca                2570

SEQ ID NO: 230
MSLQYHVLNS IPSTTFLSST KTTISSSFLT ISGSPLNVAR DKSRSGSIHC SKLRTQEYIN     60
SQEVQHDLPL IHEWQQLQGE DAPQISVGSN SNAFKEAVKS VKTILRNLTD GEITISAYDT    120
AWVALIDAGD KTPAFPSAVK WIAENQLSDG SWGDAYLFSY HDRLINTLAC VVALRSWNLF    180
PHQCNKGITF FRENIGKLED ENDEHMPIGF EVAFPSLLEI ARGINIDVPY DSPVLKDIYA    240
KKELKLTRIP KEIMHKIPTT LLHSLEGMRD LDWEKLLKLQ SQDGSFLFSP SSTAFAFMQT    300
RDSNCLEYLR NAVKRFNGGV PNVFPVDLFE HIWIVDRLQR LGISRYFEEE IKECLDYVHR    360
YWTDNGICWA RCSHVQDIDD TAMAFRLLRQ HGYQVSADVF KNFEKEGEFF CFVGQSNQAV    420
```

TABLE 3-continued

Sequences disclosed herein.

```
TGMFNLYRAS QLAFPREEIL KNAKEFSYNY LLEKREREEL IDKWIIMKDL PGEIGFALEI    480
PWYASLPRVE TRFYIDQYGG ENDVWIGKTL YRMPYVNNNG YLELAKQDYN NCQAQHQLEW    540
DIFQKWYEEN RLSEWGVRRS ELLECYYLAA ATIFESERSH ERMVWAKSSV LVKAISSSFG    600
ESSDSRRSFS DQFHEYIANA RRSDHHFNDR NMRLDRPGSV QASRLAGVLI GTLNQMSFDL    660
FMSHGRDVNN LLYLSWGDWM EKWKLYGDEG EGELMVKMII LMKNNDLTNF FTHTHFVRLA    720
EIINRICLPR QYLKARRNDE KEKTIKSMEK EMGKMVELAL SESDTFRDVS ITFLDVAKAF    780
YYFALCGDHL QTHISKVLFQ KV                                            802

SEQ ID NO: 231
atgaatttga gtttgtgtat agcatctcca ctattgacca aatctaatag accagctgct     60
ttatcagcaa ttcatacagc tagtacatcc catggtggcc aaaccaaccc tacgaatctg    120
ataatcgata cgaccaagga gagaatacaa aaacaattca aaaatgttga atttcagtt     180
tcttcttatg atactgcgtg ggttgccatg gttccatcac ctaattctcc aaagtctcca    240
tgtttcccag aatgtttgaa ttggctgatt aacaaccagt tgaatgatgg atcttggggt    300
ttagtcaatc acacgcacaa tcacaaccat ccacttttga aagattcttt atcctcaact    360
ttggcttgca tcgtggccct aaagagatgg aacgtaggtg aggatcagat taacaagggg    420
cttagtttca ttgaatctaa cttggcttcc gcgactgaaa aatctcaacc atctccaata    480
ggattcgata tcatctttcc aggtctgtta gagtacgcca aaaatctaga tatcaactta    540
ctgtctaagc aaactgattt ctcactaatg ttacacaaga ggaattaga acaaaagaga     600
tgtcattcaa acgaaatgga tggttaccta gcttatatct ctgaaggtct tggtaatctt    660
tacgattgga atatggtgaa aaagtaccag atgaaaaatg gctcagtttt caattcccct    720
tctgcaactg cggcagcatt cattaaccat caaaatccag gatgcctgaa ctatttgaat    780
tcactactag acaaattcgg caacgcagtt ccaactgtat accctcacga tttgtttatc    840
agattgagta tggtggatac aattgaaaga cttggtatat cccaccactt tagagtcgag    900
atcaaaaatg ttttggatga gacataccgt gttgggtgg agagagatga acaaatcttt     960
atggatgttg tgacgtgcgc gttggccttt agattgttgc gtattaacgg ttacgaagtt   1020
agtccagatc cacttgccga aattacaaac gaattagctt taaggatga atacgccgtc    1080
cttgaaacat atcatgcgtc acatatcctt taccaagagg acttatcatc tggaaaacaa    1140
attcttaaat ctgctgattt cctgaaggaa atcatatcca ctgatagtaa tagactgtcc    1200
aaactgatcc ataagaggt tgaaaatgca cttaagttcc ctattaacac cggcttagaa    1260
cgtattaaca caagacgtaa catccagctt tacaacgtag acaatactag aatcttgaaa    1320
accacttacc attcttccaa catatcaaac actgatattc taagattagc tgttgaagat    1380
ttctacacat gtcagtctat ctatagaaaa gagctgaaag gattagagag atgggtcgtt    1440
gagaataagc tagatcaatt gaaatttgcc agacaaaaga cagcttattg ttacttctca    1500
gttgccgcca ctttatcaag tccagaattg tcagatgcac gtatttcttg ggctaaaaac    1560
ggaatttttga caactgttgt tgatgatttc tttgatattg gcgggacaat cgacgaattg    1620
acaaacctga ttcaatgcgt tgaaaagtgg aatgtcgatg tcgataaaga ctgttgctca    1680
gaacatgtta gaatactgtt cttggctctg aaagatgcta tctgttggat cggggatgag    1740
gctttcaaat ggcaagctag agatgtgacg tctcacgtca ttcaaacctg gctagaactg    1800
atgaactcta tgttgagaga agcaaatttgg actagagatg catacgttcc tacattaaac    1860
gagtatatgg aaaacgctta tgtctccttt gcttgggtc ctatcgttaa gcctgccata    1920
tactttgtag accaaagct atccgaggaa atcgtcgaat catcagaata ccataacttg    1980
ttcaagttaa tgtccacaca aggcagatta cttaatgata ttcattcttt caaaagagag    2040
tttaaggaag gaaagttaaa tgctgttgct cttcatcttt ctaatggcga aagtggtaaa    2100
gtcgaagagg aagtagttga ggaaatgatg atgatcaa aaaacaagag aaaggagttg     2160
atgaaactaa tcttcgaaga aacggttca attgttccta gagcatgtaa ggatgcattt    2220
tggaacatgt gtcatgtgct aaacttttc tacgcaaacg acgatggttt tactgggaac    2280
acaatactag atacagtaaa agacatcata tacaacccct tggtcttagt aaacgaaaac    2340
gaggagcaaa gataa                                                    2355

SEQ ID NO: 232
MNLSLCIASP LLTKSNRPAA LSAIHTASTS HGGQTNPTNL IIDTTKERIQ KQFKNVEISV     60
SSYDTAWVAM VPSPNSPKSP CFPECLNWLI NNQLNDGSWG LVNHTHNHNH PLLKDSLSST    120
LACIVALKRW NVGEDQINKG LSFIESNLAS ATEKSQPSPI GFDIIFPGLL EYAKNLDINL    180
LSKQTDFSLM LHKRELEQKR CHSNEMDGYL AYISEGLGNL YDWNMVKKYQ MKNGSVFNSP    240
SATAAAFINH QNPGCLNYLN SLLDKFGNAV PTVYPHDLFI RLSMVDTIER LGISHHFRVE    300
IKNVLDETYR CWVERDEQIF MDVVTCALAF RLLRINGYEV SPDPLAEITN ELALKDEYAA    360
LETYHASHIL YQEDLSSGKQ ILKSADFLKE IISTDSNRLS KLIHKEVENA LKFPINTGLE    420
RINTRRNIQL YNVDNTRILK TTYHSSNISN TDYLRLAVED FYTCQSIYRE ELKGLERWVV    480
ENKLDQLKFA RQKTAYCYFS VAATLSSPEL SDARISWAKN GILTTVVDDF FDIGGTIDEL    540
TNLIQCVEKW NVDVDKDCCS EHVRILFLAL KDAICWIGDE AFKWQARDVT SHVIQTWLEL    600
MNSMLREAIW TRDAYVPTLN EYMENAYVSF ALGPIVKPAI YFVGPKLSEE IVESSEYHNL    660
FKLMSTQGRL LNDIHSFKRE FKEGKLNAVA LHLSNGESGK VEEEVVEEMM MMIKNKRKEL    720
MKLIFEENGS IVPRACKDAF WNMCHVLNFF YANDDGFTGN TILDTVKDII YNPLVLVNEN    780
EEQR                                                                784

SEQ ID NO: 233
atgaatctgt cccttttgtat agctagtcca ctgttgacaa atcttctag accaactgct      60
ctttctgcaa ttcatactgc cagtactagt catggagtc aaacaaacct aacaaatttg     120
ataatcgata ctactaagga gagaatccaa aagctattca aaaatgttga atctcagta     180
tcatcttatg acaccgcatg ggttgcaatg gtgccatcac ctaattcccc aaaaagtcca    240
tgttttccag agtgcttgaa ttggttaatc aataatcagt taaacgatgg ttcttggggt    300
ttagtcaacc cactcataa ccacaatcat ccattattga aggactcttt atcatcaaca     360
ttagcctgta ttgttgcatt gaaaagatgg aatgtaggtg aagatcaaat caacaagggt    420
ttatcattca tagaatccaa tctagcttct gctaccgaca aatcacaacc atctccaatc    480
gggttcgaca taatcttccc tggtttgctg agtatgcca aaaccttga tatcaactta     540
ctgtctaaac aaacagattt ctctttgatg ctacacaaaa gagagttaga gcagaaaaga    600
tgccattcta acgaaattga cgggtactta gcatatatct cagaaggttt gggtaatttg    660
```

TABLE 3-continued

Sequences disclosed herein.

```
tatgactgga acatggtcaa aaagtatcag atgaaaaatg gatccgtatt caattctcct    720
tctgcaactg ccgcagcatt cattaatcat caaaaccctg ggtgtcttaa ctacttgaac    780
tcactattag ataagtttgg aaatgcagtt ccaacagtct atcctttgga cttgtacatc    840
agattatcta tggttgacac tatagagaga ttaggtattt ctcatcattt cagagttgag    900
atcaaaaatg tttttggacga gacatacaga tgttgggtcg aaagagatga gcaaatcttt    960
atggatgtcg tgacctgcgc tctggctttt agattgctaa ggatacacgg atacaaagta   1020
tctcctgatc aactggctga gattacaaac gaactggctt tcaaagacga atacgccgca   1080
ttagaaacat accatgcatc ccaaatactt taccaggaag acctaagttc aggaaaacaa   1140
atcttgaagt ctgcagattt cctgaaaggc attctgtcta cagatagtaa taggttgtct   1200
aaattgatac acaaggaagt agaaaacgca ctaaagtttc ctattaacac tggtttagag   1260
agaatcaata ctaggagaaa cattcagctg tacaacgtag aaatacaag gattcttaag   1320
accacctacc atagttcaaa catttccaac acctattact taagattagc tgtcgaagac   1380
ttttacactt gtcaatcaat ctacagagag gagttaaagg gcctagaaag atgggtagtt   1440
caaaacaagt tggatcaact gaagtttgct agacagaaga cagcatactg ttatttctct   1500
gttgctgcta ccctttcatc cccagaattg tctgatgcca gaataagttg gccaaaaat   1560
ggtattctta caactgtagt cgatgatttc tttgatattg gaggtactat tgatgaactg   1620
acaaatctta ttcaatgtgt tgaaaagtgg aacgtggatg tagataagga ttgctgcagt   1680
gaacatgtga gaatactttt cctggctcta aagatgcaa tatgttggat tggcgacgag   1740
gccttcaagt ggcaagctag agatgttaca tctcatgtca tccaaacttg gcttgaactg   1800
atgaactcaa tgctaagaga agcaatctgg acaagagatg catacgttcc aacattgaac   1860
gaatacatgg aaaacgctta cgtctcattt gccttgggtc ctattgttaa gccagccata   1920
tactttgttg ggcaaagtt atccgaagag attgttgagt cttccgaata tcataaccta   1980
ttcaagttaa tgtcaacaca aggcagactt ctgaacgata tccactcctt caaaagagaa   2040
ttcaaggaag gtaagctaaa cgctgttgct ttgcacttgt ctaatggtga atctggcaaa   2100
gtggaagagg aagtcgttga ggaaatgatg atgatgatca aaaacaagag aaaggaattg   2160
atgaaattga ttttcgagga aaatggttca atcgtaccta gagcttgtaa agatgctttt   2220
tggaatatgt gccatgttct taacttcttt tacgctaatg atgatggctt cactggaaat   2280
acaatattgg atacagttaa agatatcatc tacaacccac ttgttttggt caatgagaac   2340
gaggaacaaa gataa                                                    2355

SEQ ID NO: 234
MNLSLCIASP LLTKSSRPTA LSAIHTASTS HGGQTNPTNL IIDTTKERIQ KLFKNVEISV     60
SSYDTAWVAM VPSPNSPKSP CFPECLNWLI NNQLNDGSWG LVNHTHNHNH PLLKDSLSST    120
LACIVALKRW NVGEDQINKG LSFIESNLAS ATDKSQPSPI GFDIIFPGLL EYAKNLDINL    180
LSKQTDFSLM LHKRELEQKR CHSNEIDGYL AYISEGLGNL YDWNMVKKYQ MKNGSVFNSP    240
SATAAAFINH QNPGCLNYLN SLLDKFGNAV PTVYPLDLYI RLSMVDTIER LGISHHFRVE    300
IKNVLDETYR CWVERDEQIF MDVVTCALAF RLLRIHGYKV SPDQLAEITN ELAFKDEYAA    360
LETYHASQIL YQEDLSSGKQ ILKSADFLKG ILSTDSNRLS KLIHKEVENA LKFPINTGLE    420
RINTRRNIQL YNVDNTRILK TTYHSSNISN TYYLRLAVED FYTCQSIYRE ELKGLERWVV    480
QNKLDQLKFA RQKTAYCYFS VAATLSSPEL SDARISWAKN GILTTVVDDF FDIGGTIDEL    540
TNLIQCVEKW NVDVDKDCCS EHVRILFLAL KDAICWIGDE AFKWQARDVT SHVIQTWLEL    600
MNSMLREAIW TRDAYVPTLN EYMENAYVSF ALGPIVKPAI YFVGPKLSEE IVESSEYHNL    660
FKLMSTQGRL LNDIHSFKRE FKEGKLNAVA LHLSNGESGK VEEEVVEEMM MMIKNKRKEL    720
MKLIFEENGS IVPRACKDAF WNMCHVLNFF YANDDGFTGN TILDTVKDII YNPLVLVNEN    780
EEQR                                                                 784

SEQ ID NO: 235
atggctatgc cagtgaagct aacacctgcg tcattatcct taaaagctgt gtgctgcaga     60
ttctcatccg gtggccatgc tttgagattc gggagtagtc tgccatgttg gagaaggacc    120
cctacccaaa gatctacttc ttcctctact actagaccag ctgccgaagt gtcatcaggt    180
aagagtaaac aacatgatca ggaagctagt gaagcgacta tcagacaaca attcaacttt    240
gtggatgtcc tggagaatat gggaatatcc agacattttg ctgcagagat aaagtgcata    300
cagacagaa cttacagtga cttggttacaa agacacgagg aaatcatgct ggacactatg    360
acatgtgcta tggctttag aatcctaaga ttgaacggat acaacgtttc atcagatgaa    420
ctataccacg ttgtagaggc atctggtctg cataattctt tgggtgggta tcttaacgat    480
accagaacac tacttgaatt acacaaggct tcaacagtta gtatctctga ggatgaatct    540
atcttagatt caattggctc tagatccaga acattgctta ggaacaatt ggagtctggt    600
ggcgcactga gaaagccttc tttattcaaa gaggttgaac atgcactgga tggacccttt    660
tacaccacac ttgatagact tcatcatagg tggaatattg aaaacttcaa cattattgag    720
caacacatgt tggagactcc atacttatct aaccagcata catcaaggga tatcctagca    780
ttgtcaatta gagattttc ctcctcacaa ttcacttatc aacaagagct acagcatctg    840
gagagttggg ttaaggaatg tagattagat caactacagt tcgcaagaca gaaattagcg    900
tactttacc tatcagccgc aggcaccatg ttttctcctg agcttctgat gcgagaaca    960
ttatgggcca aaaacggggt gttgacaact attgttgatg atttctttga tgttgccggt   1020
tctaaagagg aattggaaaa cttagtcatg ctggtcgaaa tgtgggataga acatcacaaa   1080
gttgaattct attctgagca ggtcgaaatc atcttctctt ccatctacga ttctgtcaac   1140
caattgggtg agaaggcctc tttggttcaa gacagatcaa ttacaaaaca ccttgttgaa   1200
atatggttag acttgttaaa gtccatgatg acggaagttg aatggagact gtcaaaatac   1260
gtgcctacag aaaaggaata catgattaat gcctctctta tcttcggcct aggtccaatc   1320
gttttaccag ctttgtattt cgttggtcca aagatttcag aaagtatagt aaaggaccca   1380
gaatatgatg aattgttcaa actaatgtca acatgtggta gattgttgaa tgacgtgcaa   1440
acgttcgaaa gagaatacaa tgagggtaaa ctgaattctg tcagtctatt ggttcttcac   1500
ggaggccaaa tgtctatttc agacgaaag aggaaattac aaaagccat tgatacgtgt   1560
agaagagatc ttcttttctt ggtccttaga gaagagtctg tagtaccaag accatgtaag   1620
gaactattct ggaaatgtg taagtgtgc tatttctttt actcaacaac tgatgggttt   1680
tctagtcaag tcgaaagagc aaaagaggta gacgctgtca taaatgagcc actgaagttg   1740
caaggttctc tacactggt atctgatgtt taa                                  1773
```

TABLE 3-continued

Sequences disclosed herein.

```
SEQ ID NO: 236
MAMPVKLTPA SLSLKAVCCR FSSGGHALRF GSSLPCWRRT PTQRSTSSST TRPAAEVSSG      60
KSKQHDQEAS EATIRQQLQL VDVLENMGIS RHFAAEIKCI LDRTYRSWLQ RHEEIMLDTM     120
TCAMAFRILR LNGYNVSSDE LYHVVEASGL HNSLGGYLND TRTLLELHKA STVSISEDES     180
ILDSIGSRSR TLLREQLESG GALRKPSLFK EVEHALDGPF YTTLDRLHHR WNIENFNIIE     240
QHMLETPYLS NQHTSRDILA LSIRDFSSSQ FTYQQELQHL ESWVKECRLD QLQFARQKLA     300
YFYLSAAGTM FSPELSDART LWAKNGVLTT IVDDFFDVAG SKEELENLVM LVEMWDEHHK     360
VEFYSEQVEI IFSSIYDSVN QLGEKASLVQ DRSITKHLVE IWLDLLKSMM TEVEWRLSKY     420
VPTEKEYMIN ASLIFGLGPI VLPALYFVGP KISESIVKDP EYDELFKLMS TCGRLLNDVQ     480
TFEREYNEGK LNSVSLLVLH GGPMSISDAK RKLQKPIDTC RRDLLSLVLR EESVVPRPCK     540
ELFWKMCKVC YFFYSTTDGF SSQVERAKEV DAVINEPLKL QGSHTLVSDV                590

SEQ ID NO: 237
atgcagaact tccatggtac aaaggaaagg atcaaaaaga tgtttgacaa gattgaattg      60
tccgtttctt cttatgatac agcctgggtt gcaatggtcc catccccctga ttgcccagaa    120
acaccttgtt ttccagaatg tactaaatgg atcctagaaa atcagttggg tgatggtagt     180
tggtcacttc ctcatggcaa tccacttcta gttaaagatg cattatcttc cactcttgct    240
tgtattctgg ctcttaaaag atggggaatc ggtgaggaac agattaacaa aggactgaga    300
ttcatagaac tcaactctgc tagtgtaacc gataacgaac aacacaaacc aattggattt    360
gacattatct ttccaggtat gattgaatac gctatagact tagacctgaa tctaccacta    420
aaaccaactg acattaactc catgttgcat cgtagagccc ttgaattgac atcaggtgga    480
ggcaaaaatc tagaaggtag aagagcttac ttggcctacg tctctgaagg aatcggtaag    540
ctgcaagatt gggaaatggc tatgaaatac aacgtagaaa acggatctct gttcaatagt    600
ccatcaacaa ctgcagctgc attcatccat atacaagatg ctgaatgcct ccactatatt    660
cgttctcttc tccagaaatt tggaaacgca gtccctacaa tatccctct cgatatctat     720
gccagacttt caatggtaga tgccctggaa cgtcttggta ttgatagaca tttcagaaag    780
gagagaaagt tcgttctgga tgaaacatac agattttggt tgcaaggaag agaggagatt    840
ttctccgata acgcaacctg tgctttggcc ttcagaatat tgagacttaa tggttacgat    900
gtctctcttg aagatcactt ctctaactct ctgggcggtt acttaaagga ctcaggagca    960
gctttagaac tgtacagagc cctccaattg tcttacccag acgagtccct cctgaaaaag   1020
caaaattcta gaacttctta cttccttaaaa caaggtttat ccaatgtctc cctctgtggt   1080
gacagattgc gtaaaaacat aattggagag gtgcatgatg cttttaaactt ttccgaccac   1140
gctaacttac aaagattagc tattcgtaga aggattaagc attacgctac tgacgataca   1200
aggattctaa aaacttccta cagatgctca acaatcggta accaagattt tctaaaactt   1260
gcagtggaag atttcaatat ctgtcaatca atacaaagag aggaattcaa gcatattgaa   1320
agatgggtcg ttgaaagacg tctagacaag ttaaagttcg ctagacaaaa aggagcctat   1380
tgctatttct cagccgcagc aacattgttt gcccctgaat tgtctgatgc tagaatgtct   1440
tgggccaaaa atggtgtatt gacaactgtg gttgatgatt tcttcgatgt cggaggctct   1500
gaagaggaat tagttaactt gatagaattg atcgagcgtt gggatgtgaa tggcagtgca   1560
gattttttgta gtgaggaagt tgagattatc tattctgcta tccactcaac tatctctgaa   1620
ataggtgata agtcatttgg ctggcaaggt agagatgtaa agtctcaagt tatcaagatc   1680
tggctggact tattgaaatc aatgttaact gaagctcaat ggtcttcaaa caagtctgtt   1740
cctaccctag atgagtatat gacaaccgcc catgtttcat tcgcacttgg tccaattgta   1800
cttccagcct tatacttcgt tggcccaaag ttgtcagaag aggttgcagg tcatcctgaa   1860
ctactaaacc tctacaaagt cacatctact tgtggcagaa tactgaatga ttggagaagt   1920
tttaagagaa aatccgagga aggtaagctc aacgctatta gtttatacat gatccactcc   1980
ggtggtgctt ctacagaaga ggaaacaatc gaacatttca aaggtttgat tgattctcag   2040
agaaggcaac tgttacaatt ggtgttgcaa gagaaggata gtatcatacc tagaccatgt   2100
aaagatctat tttggaatat gattaagtta ttacacactt tctacatgaa agatgatggc   2160
ttcacctcaa atgagatgag gaatgtagtt aaggcaatca ttaacgaacc aatctcactg   2220
gatgaattat ga                                                        2232

SEQ ID NO: 238
MSCIRPWFCP SSISATLTDP ASKLVTGEFK TTSLNFHGTK ERIKKMFDKI ELSVSSYDTA      60
WVAMVPSPDC PETPCFPECT KWILENQLGD GSWSLPHGNP LLVKDALSST LACILALKRW    120
GIGEEQINKG LRFIELNSAS VTDNEQHKPI GFDIIFPGMI EYAKDLDLNL PLKPTDINSM    180
LHRRALELTS GGGKNLEGRR AYLAYVSEGI GKLQDWEMAM KYQRKNGSLF NSPSTTAAAF    240
IHIQDAECLH YIRSLLQKFG NAVPTIYPLD IYARLSMVDA LERLGIDRHF RKERKFVLDE    300
TYRFWLQGEE EIFSDNATCA LAFRILRLNG YDVSLEDHFS NSLGGYLKDS GAALELYRAL    360
QLSYPDESLL EKQNSRTSYF LKQGLSNVSL CGDRLRKNII GEVHDALNFP DHANLQRLAI    420
RRRIKHYATD DTRILKTSYR CSTIGNQDFL KLAVEDFINC QSIQREEFKH IERWVVERRL    480
DKLKFARQKE AYCYFSAAAT LFAPELSDAR MSWAKNGVLT TVVDDFFDVG GSEEELVNLI    540
ELIERWDVNG SADFCSEEVE IIYSAIHSTI SEIGDKSFGW QGRDVKSHVI KIWLDLLKSM    600
LTEAQWSSNK SVPTLDEYMT TAHVSFALGP IVLPALYFVG PKLSEEVAGH PELLNLYKVM    660
STCGRLLNDW RSFKRESEEG KLNAISLYMI HSGGASTEEE TIEHFKGLID SQRRQLLQLV    720
LQEKDSIIPR PCKDLFWNMI KLLHTFYMKD DGFTSNEMRN VVKAIINEPI SLDEL         775

SEQ ID NO: 239
atggaatttg atgaaccatt ggttgacgaa gcaagatctt tagtgcagcg tactttacaa      60
gattatgatg acagatacgg cttcggtact atgtcatgtg ctgcttatga tacagcctgg    120
gtgtctttag ttacaaaaac agtcgatggg agaaaacaat ggcttttccc agagtgtttt    180
gaatttctac tagaaacaca atctgatgcc ggaggatggg aaatcgggaa ttcagcacca    240
atcgacggta tattgaatac agctgcatcc ttacttgcta taaaacgtca cgttcaaact    300
gagcaaatca tccaacctca acatgaccat aaggatctag caggtagagc tgaacgtgcc    360
gctgcatctt tgagagcaca attggctgca ttggatgtgt ctacaactga cacgtcggt    420
tttgagataa ttgttcctgc aatgctagac ccattagaag ccgaagatcc atctctagtt    480
ttcgattttc cagctaggaa acctttgatg aagattcatg atgctaagat gagtagattc    540
aggccagaat acttgtatgg caaacaacca atgaccgcct acattcatt agaggctttc    600
```

TABLE 3-continued

Sequences disclosed herein.

```
ataggcaaaa tcgacttcga taaggtaaga caccaccgta cccatgggtc tatgatgggt    660
tctccttcat ctaccgcagc ctacttaatg cacgcttcac aatgggatgg tgactcagag    720
gcttaccttta gacacgtgat taaacacgca gcagggcagg gaactggtgc tgtaccatct    780
gctttcccat caacacattt tgagtcatct tggattctta ccacattgtt tagagctgga    840
tttttcagctt ctcatcttgc ctgtgatgag ttgaacaagt tggtcgagat acttgagggc    900
tcattcgaga aggaaggtgg ggcaatcggt tacgctccag ggtttcaagc agatgttgat    960
gatactgcta aaacaataag tacattagca gtccttggaa gagatgctac accaagacaa   1020
atgatcaagg tatttgaagc taatacacat tttagaacat accctggtga aagagatcct   1080
tctttgacag ctaattgtaa tgctctatca gccttactac accaaccaga tgcagcaatg   1140
tatggatctc aaattcaaaa gattaccaaa tttgtctgtg actattggtg gaagtctgat   1200
ggtaagatta aagataagtg gaacacttgc tacttgtacc catctgtctt attagttgag   1260
gttttggttg atcttgttag tttattggag cagggtaaat tgcctgatgt tttggatcaa   1320
gagcttcaat acagagtcgc catcacattg ttccaagcat gtttaaggcc attactagac   1380
caagatgcca aggatcatg gaacaagtct atcgaagcca cagcctacgg catccttatc   1440
ctaactgaag ctaggagagt ttgtttcttc gacagattgt ctgagccatt gaatgaggca   1500
atccgtagag gtatcgcttt cgccgactct atgtctggaa ctgaagctca gttgaactac   1560
atttggatcg aaaaggttag ttacgcaccct gcattattga ctaaatccta tttgttagca   1620
gcaagatggg ctgctaagtc tcctttaggc gcttccgtag gctcttcttt gtggactcca   1680
ccaagagaag gattggataa gcatgtcaga ttattccatc aagctgagtt attcagatcc   1740
cttccagaat gggaattaag agcctccatg attgaagcag ctttgttcac accacttcta   1800
agagcacata gactagacgt tttccctaga caagatgtag gtgaagacaa atatcttgat   1860
gtagttccat tctttggac tgccgctaac aacagagata gaacttacgc ttccactcta   1920
ttcctttacg atatgtgttt tatcgcaatg ttaaacttcc agttagacga attcatggag   1980
gccacagccg gtatcttatt cagagatcat atggatgatt tgaggcaatt gattcatgat   2040
cttttggcag agaaaacttc cccaaagagt ctggtagaa gtagtcaggg cacaaaagat   2100
gctgactcag gtatagagga agacgtgtca atgtccgatt cagcttcaga ttcccaggat   2160
agaagtccag aatacgactt ggttttcagt gcattgagta cctttacaaa acatgtcttg   2220
caacacccat ctatacaaag tgcctctgta tgggataaaa aactacttgc tagagagatg   2280
aaggcttact tacttgctca tatccaacaa gcagaagatt caactccatt gtctgaattg   2340
aaagatgtgc ctcaaaagac tgatgtaaca agagtttcta catctactac taccttcttt   2400
aactgggtta gaacaacttc cgcagaccat atatcctgcc catactcctt ccactttgta   2460
gcatgccatc taggcgcagc attgtcacct aaagggtcta acggtgattg ctatccttca   2520
gctggtgaga agttcttggc agctgcagtc tgcagacatt tggccaccat tgtgtagaatg   2580
tacaacgatc ttgatcagc tgaacgtgat tctgatgaag gtaatttgaa ctccttggac   2640
ttccctgaat tcgccgattc cgcaggaaac ggagggtatag aaattcagaa ggccgctcta   2700
ttaaggttag ctgagtttga gagagattca tacttagagg ccttccgtcg tttacaaagat  2760
gaatccaata gagttcacgg tccagccggt ggtgatgaag ccagattgtc cagaaggaga   2820
atggcaatcc ttgaattctt cgcccagcag gtagatttgt acggtcaagt atacgtcatt   2880
agggatattt ccgctcgtat tcctaaaaac gaggttgaga aaaagagaaa attggatgat   2940
gctttcaatt ga                                                       2952

SEQ ID NO: 240
MEFDEPLVDE ARSLVQRTLQ DYDDRYGFGT MSCAAYDTAW VSLVTKTVDG RKQWLFPECF     60
EFLLETQSDA GGWEIGNSAP IDGILNTAAS LLALKRHVQT EQIIQPQHDH KDLAGRAERA    120
AASLRAQLAA LDVSTTEHVG FEIIVPAMLD PLEAEDPSLV FDFPARKPLM KIHDAKMSRF    180
RPEYLYGKQP MTALHSLEAF IGKIDFDKVR HHRTHGSMMG SPSSTAAYLM HASQWDGDSE    240
AYLRHVIKHA AGQGTGAVPS AFPSTHFESS WILTTLFRAG FSASHLACDE LNKLVEILEG    300
SPFEKEGGAIG YAPGFQADVD DTAKTISTLA VLGRDATPRQ MIKVFEANTH FRTYPGERDP   360
SLTANCNALS ALLHQPDAAM YGSQIQKITK FVCDYWWKSD GKIKDKWNTC YLYPSVLLVE    420
VLVDLVSLLE QGKLPDVLDQ ELQYRVAITL FQACLRPLLD QDAEGSWNKS IEATAYGILI    480
LTEARRVCFF DRLSEPLNEA IRRGIAFADS MSGTEAQLNY IWIEKVSYAP ALLTKSYLLA    540
ARWAAKSPLG ASVGSSLWTP PREGLDKHVR LFHQAELFRS LPEWELRASM IEAALFTPLL    600
RAHRLDVFPR QDVGEDKYLD VVPFFWTAAN NRDRTYASTL FLYDMCFIAM LNFQLDEFME    660
ATAGILFRDH MDDLRQLIHD LLAEKTSPKS SGRSSQGTKD ADSGIEEDVS MSDSASDSQD    720
RSPEYDLVFS ALSTFTKHVL QHPSIQSASV WDRKLLAREM KAYLLAHIQQ AEDSTPLSEL    780
KDVPQKTQDT RVSTSTTTFF NWVRTTSADH ISCPYSFHFV ACHLGAALSP KGSNGDCYPS    840
AGEKFLAAAV CRHLATMCRM YNDLGSAERD SDEGNLNSLD FPEFADSAGN GGIEIQKAAL    900
LRLAEFERDS YLEAFRRLQD ESNRVHGPAG GDEARLSRRR MAILEFFAQQ VDLYGQVYVI    960
RDISARIPKN EVEKKRKLDD AFN                                            983

SEQ ID NO: 241
atggcttcta gtacacttat ccaaaacaga tcatgtggcg tcacatcatc tatgtcaagt     60
tttcaaatct tcagaggtca accactaaga ttttcctggca ctagaacccc agctgcagtt   120
caatgcttga aaaagaggag atgccttagg ccaaccgaat ccgtactaga atcatctcct   180
ggctctggtt catatagaat agtaactggc ccttctggaa ttaaccctag ttctaacgga   240
cacttgcaag agggttcctt gactcacagg ttaccaatac caatggaaaa atctatcgat   300
aacttccaat ctactctata tgtgtcagat atttggtctg aaacactaca gagaactgaa   360
tgtttgctac aagtaactga aaacgtccag atgaatgagt ggattgagga aattagaatg   420
tactttagaa atatgacttt aggtgaaatt tccatgtccc cttacgacac tgcttgggtg   480
gctagagttc cagcgttgga cggttctcat gggcctcaat tccacagatc tttgcaatgg   540
attatcgaca accaattacc agatggggac tgggcgaac cttctctttt cttgggttac   600
gatagagttt gtaatacttt agcctgtgtg attgcgttga aacatggggt gttgggggca   660
caaaacgttg aggatgaat tcagttccta caatctaaca tagcaaggat gggaagat   720
gacgtaatc atatgccaat aggattcgaa atcgtattcc ctgctatgat ggaagatgcc   780
aaagcattag gtttggattt gccatacgat gctactattt gcaacagat ttcagccgaa   840
agagagaaaa agatgaaaaa gatcccaatg gcaatggtgt acaaatacccc aaccacttta   900
cttcactcct tagaaggctt gcatagaaa gttgattgga ataagttgtt acaattacaa   960
tctgaaaatg gtagttttct ttattcacct gcttcaaccg catgcgcctt aatgtacact   1020
```

TABLE 3-continued

Sequences disclosed herein.

```
aaggacgtta aatgttttga ttacttaaac cagttgttga tcaagttcga ccacgcatgc   1080
ccaaatgtat atccagtcga tctattcgaa agattatgga tggttgacag attgcagaga   1140
ttagggatct ccagatactt tgaaagagag attagagatt gtttacaata cgtctacaga   1200
tattggaaag attgtggaat cggatgggct tctaactctt ccgtacaaga tgttgatgat   1260
acagccatgg cgtttagact tttaaggact catggtttcg acgtaaagga agattgcttt   1320
agacagtttt tcaaggacgg agaattcttc tgcttcgcag gccaatcatc tcaagcagtt   1380
acaggcatgt ttaatctttc aagagccagt caaacattgt ttccaggaga atctttattg   1440
aaaaaggcta gaaccttctc tagaaacttc ttgagaacaa agcatgagaa caacgaatgt   1500
ttcgataaat ggatcattac taaagatttg gctggtgaag tcgagtataa cttgaccttc   1560
ccatggtatg cctcttttgcc tagattagaa cataggacat acttagatca atatggaatc   1620
gatgatatct ggataggcaa atctttatac aaaatgcctg ctgttaccaa cgaagttttc   1680
ctaaagttgg caaaggcaga ctttaacatg tgtcaagctc tacacaaaaa ggaattggaa   1740
caagtgataa agtggaacgc gtcctgtcaa ttcagagatc ttgaattcgc cagacaaaaa   1800
tcagtagaat gctattttgc tggtgcagcc acaatgttcg aaccagaaat ggttcaagct   1860
agattagtct gggcaagatg ttgtgtattg acaactgtct tagacgatta ctttgaccac   1920
gggacacctg ttgaggaact tagagtgttt gttcaagctg tcagaacatg gaatccagag   1980
ttgatcaacg gttgccaga gcaagctaaa atcttgttta tgggcttata caaaacagtt   2040
aacacaattg cagaggaagc attcatggca cagaaaagag acgtccatca tcatttgaaa   2100
cactattggg acaagttgat aacaagtgcc ctaaaggagg ccgaatgggc agagtcaggt   2160
tacgtcccaa catttgatga atacatgaa gtagctgaaa tttctgttgc tctagaacca   2220
attgtctgta gtaccttgtt cttttgcgggt catagactag atgaggatgt tctagatagt   2280
tacgattacc atctagttat gcatttggta aacagagtcg gtagaatctt gaatgatata   2340
caaggcatga agagggaggc ttcacaaggt aagatctcat cagttcaaat ctacatggag   2400
gaacatccat ctgttccatc tgaggccatg gcgatcgctc atcttcaaga gttagttgat   2460
aattcaatgc agcaattgac atacgaagtt cttaggttca ctgcggttcc aaaaagttgt   2520
aagagaatcc acttgaatat ggctaaaatc atgcatgcct tctacaagga tactgatgga   2580
ttctcatccc ttactgcaat gacaggattc gtcaaaaagg ttcttttcga acctgtgcct   2640
gagtaa                                                               2646

SEQ ID NO: 242
MASSTLIQNR SCGVTSSMSS FQIFRGQPLR FPGTRTPAAV QCLKKRRCLR PTESVLESSP    60
GSGSYRIVTG PSGINPSSNG HLQEGSLTHR LPIPMEKSID NFQSTLYVSD IWSETLQRTE   120
CLLQVTENVQ MNEWIEEIRM YFRNMTLGEI SMSPYDTAWV ARVPALDGSH GPQFHRSLQW   180
IIDNQLPDGD WGEPSLFLGY DRVCNTLACV IALKTWGVGA QNVERGIQFL QSNIYKMEED   240
DANHMPIGFE IVFPAMMEDA KALGLDLPYD ATILQQISAE REKKMKKIPM AMVYKYPTTL   300
LHSLEGLHRE VDWNKLLQLQ SENGSFLYSP ASTACALMYT KDVLCFDYLN QLLIKFDHAC   360
PNVYPVDLFE RLWMVDRLQR LGISRYFERE IRDCLQYVYR YWKDCGIGWA SNSSVQDVDD   420
TAMAFRLLRT HGFDVKEDCF RQFFKDGEFF CFAGQSSQAV TGMFNLSRAS QTLFPGESLL   480
KKARTFSRNF LRTKHENNEC FDKWIITKDL AGEVEYNLTF PWYASLPRLE HRTYLDQYGI   540
DDIWIGKSLY KMPAVTNEVF LKLAKADFNM CQALHKKELE QVIKWNASCQ FRDLEFARQK   600
SVECYFAGAA TMFEPEMVQA RLVWARCCVL TTVLDDYFDH GTPVEELRVF VQAVRTWNPE   660
LINGLPEQAK ILFMGLYKTV NTIAEEAFMA QKRDVHHHLK HYWDKLITSA LKEAEWAESG   720
YVPTFDEYME VAEISVALEP IVCSTLFFAG HRLDEDVLDS YDYHLVMHLV NRVGRILNDI   780
QGMKREASQG KISSVQIYME EHPSVPSEAM AIAHLQELVD NSMQQLTYEV LRFTAVPKSC   840
KRIHLNMAKI MHAFYKDTDG FSSLTAMTGF VKKVLFEPVP E                       881

SEQ ID NO: 243
atgcctggta aaattgaaaa tggtacccca aaggacctca agactggaaa tgattttgtt    60
tctgctgcta agagtttact agatcgagct ttcaaaagtc atcattccta ctacggatta   120
tgctcaactt catgtcaagt ttatgataca gcttgggttg caatgattcc aaaaacaaga   180
gataatgtaa aacagtggtt gttccagaaa tgtttccatt acctcttaaa aacacaagcc   240
gcagatggct catggggttc attgcctaca acacagacaa cgggtatcct agatacgacc   300
tcagctgtgc tggcattatt gtgccacgca caagagcctt tacaaatatt ggatgtatct   360
ccagatgaaa tggggttgag aatagaaacac ggtgtcacat ccttgaaacg tcaattagca   420
gtttggaatg atgtgagga caccaaccat attggcgtcg agtttatcat accagcctta   480
cttttccatg ctagaaaagga attagatgtt ccatcttttg aatttccatg taggtccatc   540
ttagagagaa tgcacgggga gaaattaggt catttcgacc tggaacaagt ttacggcaag   600
ccaagctcat tgttgcactc attggaagca tttctcggta agctagattt tgatcgacta   660
tcacatcacc tataccacgg cagtatgatg gcatctccat cttcaacggc tgcttatctt   720
attggggcta caaaatggga tgacgaagcc gaagattacc taagacatgt aatgcgtaat   780
ggtgcaggac atgggaatgg aggtatttct ggtacatttc caactactca tttcgaatgt   840
agctggatta tagcaacgtt gttaaaggtt ggctttactt tgaagcaaat tgacggcgat   900
ggcttaagag gttatcaac catcttactt gaggcgcttc gtgatgagaa tggtgtcata   960
ggctttgccc ctagaacagc agatgtagat gacacagcca agctctatt ggccttgtca   1020
ttggtaaacc agccagtgtc acctgatatc atgattaagg tctttgaggg caaagaccat  1080
tttaccactt ttggttcaga aagagatcca tcattgactt ccaacctgca cgtcctttta  1140
tctttactta aacaatctaa cttgtctcaa taccatcctc aaatcctcaa acaacatta   1200
ttcacttgta gatggtggtg gggttccgat cattgtgtca agacaaatg gaatttgagt   1260
cacctatatc caactatgtt gttgttgaa gccttcacctg aagtgctcca tctcattgaa  1320
ggtggtgaat tgtctagtct gtttgatgaa tccttttaagt gtaagattgt tcttagcatc  1380
tttcaagcgg tacttagaat aatcctcacc caagacaacg acggcctttg gagaggatac  1440
agagaacaga cgtgttacgc aatattggct ttagttcaag cgacacatgt atgctttttc  1500
actcacgtta ttgacagact gcaatcatgt gttgatcgag tttctcatg gttgaaatct  1560
tgctcttttc attctcaaga cctgacttgg acctctaaaa cagcttatga agtgggttc   1620
gtagctgaag catataaact agctgcttta caatctgctt ccctggaggt tcctgctgcc  1680
accattggac attctgtcac gtctgccgtt ccatcaagtg atcttgaaaa atacatgaga  1740
ttggtgagaa aaactgcgtt attctctcca ctggatgagt ggggtctaat ggcttctatc  1800
atcgaatctt cattttttcgt accattactg caggcacaaa gagttgaaat atacccctaga 1860
```

TABLE 3-continued

Sequences disclosed herein.

```
gataatatca aggtggacga agataagtac ttgtctatta tcccattcac atgggtcgga   1920
tgcaataata ggtctagaac tttcgcaagt aacagatggc tatacgatat gatgtacctt   1980
tcattactcg gctatcaaac cgacgagtac atggaagctg tagctgggcc agtgtttggg   2040
gatgtttcct tgttacatca aacaattgat aaggtgattg ataatacaat gggtaacctt   2100
gcgagagcca atggaacagt acacagtggt aatggacatc agcacgaatc tcctaatata   2160
ggtcaagtcg aggacacctt gactcgtttc acaaattcag tcttgaatca aaagacgtc    2220
cttaactcta gctcatctga tcaagatact ttgagagaag agtttagaac attcatgcac   2280
gctcatataa cacaaatcga agataactca cgattcagta agcaagcctc atccgatgcg   2340
ttttcctctc ctgaacaatc ttactttcaa tgggtgaact caactggtgg ctcacatgtc   2400
gcttgcgcct attcatttgc cttctctaat tgcctcatgt ctgcaaattt gttgcagggt   2460
aaagacgcat ttccaagcgg aacgcaaaag tacttaatct cctctgttat gagacatgcc   2520
acaaacatgt gtagaatgta taacgacttt ggctctattg ccagagacaa cgctgagaga   2580
aatgttaata gtattcattt tcctgagttt actctctgta acggaacttc tcaaaaccta   2640
gatgaaagga aggaaagact tctgaaaatc gcaacttacg aacaagggta tttggataga   2700
gcactagagg ccttggaaag acagagtgga gatgatgccg gagacagagc tggatctaaa   2760
gatatgagaa agttgaaaat cgttaagtta ttctgtgatg ttacggactt atacgatcag   2820
ctctacgtta tcaaagattt gtcatcctct atgaagtaa                          2859

SEQ ID NO: 244
MPGKIENGTP KDLKTGNDFV SAAKSLLDRA FKSHHSYYGL CSTSCQVYDT AWVAMIPKTR    60
DNVKQWLFPE CFHYLLKTQA ADGSWGSLPT TQTAGILDTA SAVLALLCHA QEPLQILDVS   120
PDEMGLRIEH GVTSLKRQLA VWNDVEDTNH IGVEFIIPAL LSMLEKELDV PSFEFPCRSI   180
LERMHGEKLG HFDLEQVYGK PSSLLHSLEA FLGKLDFDRL SHHLYHGSMM ASPSSTAAYL   240
IGATKWDDEA EDYLRHVMRN GAGHGNGGIS GTFPTTHFEC SWIIATLLKV GFTLKQIDGD   300
GLRGLSTILL EALRDENGVI GFAPRTADVD DTAKALLALS LVNQPVSPDI MIKVFEGKDH   360
FTTFGSERDP SLTSNLHVLL SLLKQSNLSQ YHPQILKTTL FTCRWWWGSD HCVKDKWNLS   420
HLYPTMLLVE AFTEVLHLID GGELSSLFDE SFKCKIGLSI FQAVLRIILT QDNDGSWRGY   480
REQTCYAILA LVQARHVCFF THMVDRLQSC VDRGFSWLKS CSFHSQDLTW TSKTAYEVGF   540
VAEAYKLAAL QSASLEVPAA TIGHSVTSAV PSSDLEKYMR LVRKTALFSP LDEWGLMASI   600
IESSFFVPLL QAQRVEIYPR DNIKVDEDKY LSIIPFTWVG CNNRSRTFAS NRWLYDMMYL   660
SLLGYQTDEY MEAVAGPVFG DVSLLHQTID KVIDNTMGNL ARANGTVHSG NGHQHESPNI   720
GQVEDTLTRF TNSVLNHKDV LNSSSSDQDT LRREFRTFMH AHITQIEDNS RFSKQASSDA   780
FSSPEQSYFQ WVNSTGGSHV ACAYSFAFSN CLMSANLLQG KDAFPSGTQK YLISSVMRHA   840
TNMCRMYNDF GSIARDNAER NVNSIHFPEF TLCNGTSQNL DERKERLLKI ATYEQGYLDR   900
ALEALERQSR DDAGDRAGSK DMRKLKIVKL FCDVTDLYDQ LYVIKDLSSS MK           952

SEQ ID NO: 245
aagcttacta gtaaaatgga cggtgtcatc gatatgcaaa ccattccatt gagaaccgct    60
attgctattg gtggtactgc tgttgctttg gttgttgcat tatacttttg gttcttgaga   120
tcctacgctt ccccatctca tcattctaat catttgccac cagtacctga agttccaggt   180
gttccagttt tgggtaattt gttgcaattg aaagaaaaaa agcctacat gaccttcacc    240
aagtgggctg aaatgtatgg tccaatctac tctattagaa ctggtgctac ttccatggtt   300
gttgtctctt ctaacgaaat cgccaaagaa gttgttgtta ccagattccc atctatctct   360
accagaaaat tgtcttacgc cttgaaggtt tgaccgaag ataagtctat ggttgccatg   420
tctgattatc acgattacca taagaccgtc aagagacata ttttgactgc tgtttttggt   480
ccaaacgccc aaaaaagtt tagagcacat agagacacca tgatgaaaaa cgtttccaat   540
gaattgcatg ccttcttcga aaagaaccca aatcaagaag tcaacttgag aaagatcttc   600
caatcccaat tattcggttt ggctatgaag caagccttgg gtaaagatgt tgaatccatc   660
tacgttaagg atttggaaac caccatgaag agagaagaaa tcttcgaagt tttggttgtc   720
gatccaatga tgggtgctat tgaagttgat tggagagact ttttcccata cttgaaatgg   780
gttccaaaca agtccttcga aaacatcatc catagaatgt acactagaag agaagctgtt   840
atgaaggcct tgatccaaga acacaagaaa gaattgcct ccggtgaaaa cttgaactcc    900
tacattgatt acttgttgtc tgaagcccaa accttgaccg ataagcaatt attgatgtct   960
ttgtgggaac ctattatcga atcttctgat accactactg ttactactga ttggcctatg   1020
tacgaattgg ctaagaatcc aaacatgcaa gacagattat acgaagaaat ccaatccgtc   1080
tgcggttccg aaaagattac tgaagaaaac ttgtcccaat gccatactt gtacgctgtt    1140
ttccaagaaa ctttgagaaa gcactgtcca gttcctatta tgccattgag atatgttcac   1200
gaaaacaccg ttttgggtgg ttatcatgtt ccagctggta ctgaagttgc tattaacatc   1260
tacggttgca acatggataa gaaggtctgg gaaaatccaa aagaatggaa tccagaaaga   1320
ttcttgtccg aaaaagaatc catggacttg tacaaaacta tggctttttgg tggtggtaaa   1380
agagtttgcg ctggttcttt acaagccatg gttatttctt gcattggtat cggtagattg   1440
gtccaagatt ttgaatggaa gttgaaggat gatgccgaag aagatgttaa cactttgggt   1500
ttgactaccc aaaaagttgca tccattattg gccttgatta cccaagaaa gtaactgag    1560
ccgcgg                                                              1566

SEQ ID NO: 246
MDGVIDMQTI PLRTAIAIGG TAVALVVALY FWFLRSYASP SHHSNHLPPV PEVPGVPVLG    60
NLLQLKEKKP YMTFTKWAEM YGPIYSIRTG ATSMVVVSSN EIAKEVVVTR FPSISTRKLS   120
YALKVLTEDK SMVAMSDYHD YHKTVKRHIL TAVLGPNAQK KFRAHRDTMM ENVSNELHAF   180
FEKNPNQEVN LRKIFQSQLF GLAMKQALGK DVESIYVKDL ETTMKREEIF EVLVVDPMMG   240
AIEVDWRDFF PYLKWVPNKS FENIIHRMYT RREAVMKALI QEHKKRIASG ENLNSYIDYL   300
LSEAQTLTDK QLLMSLWEPI IESSDTTMVT TEWAMYELAK NPNMQDRLYE EIQSVCGSEK   360
ITEENLSQLP YLYAVFQETL RKHCPVPIMP LRYVHENTVL GGYHVPAGTE VAINIYGCNM   420
DKKVWENPEE WNPERFLSEK ESMDLYKTMA FGGGKRVCAG SLQAMVISCI GIGRLVQDFE   480
WKLKDDAEED VNTLGLTTQK LHPLLALINP RK                                 512
```

TABLE 3-continued

Sequences disclosed herein.

```
SEQ ID NO: 247
atggccaccc tccttgagca ttttccaagct atgcccttttg ccatccctat tgcactggct      60
gctctgtctt ggctgttcct cttttacatc aaagtttcat tcttttccaa caagagtgct     120
caggctaagc tccctcctgt gccagtggtt cctgggctgc cggtgattgg gaatttactg     180
caactcaagg agaagaaacc ctaccagact tttacaaggt gggctgagga gtatggacca     240
atctattcta tcaggactgg tgcttccacc atggtcgttc tcaataccac ccaagttgca     300
aaagaggcca tggtgaccag atatttatcc atctcaacca gaaagctatc aaacgcacta     360
aagattctta ctgctgataa atgtatggtt gcaataagtg actacaacga ttttcacaag     420
atgataaagc gatacatact ctcaaatgtt cttggaccta gtgctcagaa gcgtcaccgg     480
agcaacagag ataccttgag agctaagtc tgcagccgat tgcattctca agtaaagaac     540
tctcctcgag aagctgtgaa tttcagaaga gttttgagt gggaactctt ggaattgca      600
ttgaagcaag cctttggaaa ggacatagaa aagcccattt atgtggagga acttggcact     660
acactgtcaa gagatgagat cttaaggtt ctagtgcttg acataatgga gggtgcaatt     720
gaggttgatt ggagagattt cttcccttac ctgagatgga ttccgaatac gcgcatggaa     780
acaaaaattc agcgactcta tttccgcagg aaagcagtga tgactgccct gatcaacgag     840
cagaagaagc gaattgcttc aggagaggaa atcaactgtt atatcgactt cttgcttaag     900
gaagggaaga cactgacaat ggaccaaata agtatgttgc tttgggagac ggttattgaa     960
acagcagata ctacaatggt aacgacagaa tgggctatgt atgaagttgc taaagactca    1020
aagcgtcagg atcgtctcta tcaggaaatc caaaaggttt gtggatcgga gatggttaca    1080
gaggaatact tgtcccaact gccgtacctg aatgcagttt tccatgaaac gctaaggaag    1140
cacagtccgg ctgcgttagt tccttttaag atatgcacatg aagataccca actaggaggt    1200
tactacattc cagctggaac tgagattgct ataaacatat acgggtgtaa catggacaag    1260
catcaatggg aaagccctga ggaatgaaaa ccggagagat ttttggaccc gaaatttgat    1320
cctatggatt tgtacaagac catggctttt ggggctggaa gaggggtatg tgctggttct    1380
cttcaggcaa tgttaatagc gtgcccgacg attggtaggc tggtgcagga gtttgagtgg    1440
aagctgagag atggagaaga agaaaatgta gatactgttg gctcaccac tcacaaacgc     1500
tatccaatgc atgcaatcct gaagccaaga agtta                               1535

SEQ ID NO: 248
atggctacct tgttggaaca ttttcaagct atgccattcg ctattccaat tgctttggct      60
gctttgtctt ggttgttttt gttctacatc aaggtttcat tcttctccaa caaatccgct     120
caagctaaat tgccaccagt tccagttgtt ccaggttttgc cagttattgg taatttgttg     180
caattgaaag aaaagaagcc ataccaaacc ttcactagat gggctgaaga atatggtcca     240
atctactcta ttagaactgg tgcttctact atggttgtct tgaacactac tcaagttgcc     300
aaagaagcta tggttaccag atacttgtct atctctacca gaaagttgtc caacgccttg     360
aaaattttga ccgctgataa gtgcatggtt gccattcctg attacaacga tttccacaag     420
atgatcaaga gatatatctt gtctaacgtt ttgggtccat ctgcccaaaa aagacataga     480
tctaacagag ataccttgag agccaacgtt tgttctagat gcattccca agttaagaac      540
tctccaagag aagctgtcaa ctttagaaga gttttcgaat gggaattatt cggtatcgct     600
ttgaaacaag ccttcggtaa ggatattgaa aagccaatct acgtcgaaga attgggtact     660
actttgtcca gagatgaaat cttcaaggtt ttggtcttgg acattatgga aggtgccatt     720
gaagttgatt ggagagattt tttcccatac ttgcgttgga ttccaaacac cagaatggaa     780
actaagatcc aaagattata ctttagaaga aaggccgtta tgcccgcctt gattaacgaa     840
caaaagaaaa gaattgcctc cggtgaagaa atcaactgtt acatcgattt cttgttgaaa     900
gaaggtaaga ccttgaccat ggaccaaatc tctatgttgt tgtgggaaac cgttattgaa     960
actgctgata ccacaatggt tactactgaa tgggctatgt acgaagttgc taaggattct    1020
aaaagacaag acagattata ccaagaaatc caaaaggtct gcggttctga aatggttaca    1080
gaagaatact tgtcccaatt gccatacttg aatgctgttt tccacgaaac tttgagaaaa    1140
cattctccag ctgctttggt tccattgaga tatgctcatg aagatactca attgggtggt    1200
tattacattc cagccggtac tgaaattgcc attaacatct acggttgcaa catggacaaa    1260
caccaatggg aatctccaga agaatggaag ccagaaagat ttttggatcc taagtttgac    1320
ccaatggact tgtacaaaac tatggctttt ggtgctggta gaaagagttg cgctggttct    1380
ttacaagcta tgttgattgc ttgtccaacc atcggtagat tggttcaaga atttgaatgg    1440
aagttgagag atggtgaaga agaaaacgtt gatactgttg gtttgaccac ccataagaga    1500
tatccaatgc atgctatttt gaagccaaga tcttaa                              1536

SEQ ID NO: 249
MATLLEHFQA MPFAIPIALA ALSWLFLFYI KVSFFSNKSA QAKLPPVPVV PGLPVIGNLL      60
QLKEKKPYQT PTRWAEEYGP IYSIRTGAST MVVLNTTQVA KEAMVTRYLS ISTRKLSNAL     120
KILTADKCMV AISDYNDFHK MIKRYILSNV LGPSAQKRHR SNRDTLRANV CSRLHSQVKN     180
SPREAVNFRR VFEWELFGIA LKQAFGKDIE KPIYVEELGT TLSRDEIFKV LVLDIMEGAI     240
EVDWRDFFPY LRWIPNTRME TKIQRLYFRR KAVMTALINE QKKRIASGEE INCYIDFLLK     300
EGKTLTMDQI SMLLWETVIE TADTTMVTTE WAMYEVAKDS KRQDRLYQEI QKVCGSEMVT     360
EEYLSQLPYL NAVFHETLRK HSPAALVPLR YAHEDTQLGG YYIPAGTEIA INIYGCNMDK     420
HQWESPEEWK PERFLDPKFD PMDLYKTMAF GAGKRVCAGS LQAMLIACPT IGRLVQEFEW     480
KLRDGEEENV DTVGLTTHKR YPMHAILKPR S                                    511

SEQ ID NO: 250
aagcttacta gtaaaatggc ctccatcacc catttcttac aagattttca agctactcca      60
ttcgctactg cttttgctgt tggtggtgtt tctttgttga tattcttctt cttcatccgt     120
ggtttccact actactaagaa aaacgaatat acaagttgc caccagttcc agttgttcca     180
ggtttgccag ttgttggtaa tttgttgcaa ttgaaagaaa agaagccata caagactttc     240
ttgagatggg ctgaaattca tggtccaatc tactctatta gaactggtgc ttctaccatg     300
gttgttgtta actctactca tgttgccaaa gaagctatgg ttaccagatt ctcttcaatc     360
tctaccagaa agttgtccaa ggctttgaaa ttattgacct ccaacaaatc tatggttgcc     420
acctctgatt acaacgaatt tcacaagatg gtcaagaagt acatccttgg cgaattattg     480
ggtgctaatg ctcaaaagag acacagaatt catagagaca ccttgatcga aacgtccttg     540
```

TABLE 3-continued

Sequences disclosed herein.

```
aacaaattgc atgcccatac caagaattct ccattgcaag ctgttaactt cagaaagatc   600
ttcgaatctg aattattcgg tttggctatg aagcaagcct tgggttatga tgttgattcc   660
ttgttcgttg aagaattggg tactaccttg tccagagaag aaatctacaa cgtttttggtc  720
agtgacatgt tgaagggtgc tattgaagtt gattggagag actttttccc atacttgaaa   780
tggatcccaa acaagtcctt cgaaatgaag attcaaagat tggcctctag aagacaagcc   840
gttatgaact ctattgtcaa agaacaaaag aagtccattg cctctggtaa gggtgaaaac   900
tgttacttga attacttgtt gtccgaagct aagactttga ccgaaaagca aatttccatt   960
ttggcctggg aaaccattat tgaaactgct gatacaactg ttgttaccac tgaatgggct  1020
atgtacgaat tggctaaaaa cccaaagcaa caagacagat tatacaacga aatccaaaac  1080
gtctgcggta ctgataagat taccgaagaa catttgtcca agttgcctta cttgtctgct  1140
gttttttcacg aaaccttgag aaagtattcc ccatctccat tgttgccatt gagatacgct  1200
catgaagata ctcaattggg tggttattat gttccagccg gtactgaaat tgctgttaat  1260
atctacggtt gcaacatgga caagaatcaa tgggaaactc cagaagaatg gaagccagaa  1320
agattttttgg acgaaaagta cgatccaatg gacatgtaca agactatgtc ttttggttcc  1380
ggtaaaagag tttgcgctgg ttcttttacaa gctagtttga ttgcttgtac ctccatcggt  1440
agattggttc aagaatttga atggagattg aaagacggtg aagttgaaaa cgttgatacc  1500
ttgggtttga ctacccataa gttgtatcca atgcaagcta tcttgcaacc tagaaactga  1560
ctcgagccgc gg                                                       1572

SEQ ID NO: 251
MASITHFLQD FQATPFATAF AVGGVSLLIF FFFIRGFHST KKNEYYKLPP VPVVPGLPVV    60
GNLLQLKEKK PYKTFLRWAE IHGPIYSIRT GASTMVVVNS THVAKEAMVT RFSSISTRKL   120
SKALELLTSN KSMVATSDYN EFHKMVKKYI LAELLGANAQ KRHRIHRDTL IENVLNKLHA   180
HTKNSPLQAV NFRKIFESEL FGLAMKQALG YDVDSLFVEE LGTTLSREEI YNVLVSDMLK   240
GAIEVDWRDF FPYLKWIPNK SFEMKIQRLA SRRQAVMNSI VKEQKKSIAS GKGENCYLNY   300
LLSEAKTLTE KQISILAWET IIETADTTVV TTEWAMYELA KNPKQQDRLY NEIQNVCGTD   360
KITEEHLSKL PYLSAVFHET LRKYSPSPLV PLRYAHEDTQ LGGYYVPAGT EIAVNIYGCN   420
MDKNQWETPE EWKPERFLDE KYDPMDMYKT MSFGSGKRVC AGSLQASLIA CTSIGRLVQE   480
FEWRLKDGEV ENVDTLGLTT HKLYPMQAIL QPRN                               514

SEQ ID NO: 252
atgatttcct tgttgttggg ttttgttgtc cctccttct tgtttatctt cttcttgaaa     60
aaattgttgt tcttcttcag tcgtcacaaa atgtccgaag tttctagatt gccatctgtt   120
ccagttccag gttttccatt gattggtaac ttgttgcaat tgaaagaaaa gaagccacac   180
aagactttca ccaagtggtc tgaattatat ggtccaatct actctatcaa gatgggttcc   240
tcttcttttga tcgtcttgaa ctctattgaa accgccaaag aagctatggt cagtagattc   300
tcttcaatct ctaccagaaa gttgtctaac gctttgactg ttttgacctg caacaaatct   360
atggttgcta cctctgatta cgatgacttt cataagttcg tcaagagatg cttgttgaac   420
ggtttgttgg gtgctaatgc tcaagaaaga aaaagacatt acagagatgc cttgatcgaa   480
aacgttacct ctaaattgca tgcccatacc agaaatcatc cacaagaacc agttaacttc   540
agagccattt tcgaacacga attattcggt gttgctttga aacaagcctt cggtaaagat   600
gtcgaatcca tctatgtaaa agaattgggt gtcaccttgt ccagagatga aatttttcaag   660
gttttggtcc acgacatgat ggaaggtgct attgatgttg attggagaga tttcttccca   720
tacttgaaat ggatcccaaa caactctttc gaagccagaa ttcaacaaaa gcacaagaga   780
agattggctg ttatgaacgc cttgatccaa gacagattga atcaaaacga ttccgaatcc   840
gatgatgact gctacttgaa tttcttgatg tctgaagcta agaccttgac catggaacaa   900
attgctattt tggtttggga accattatc gaaactgctg ataccacttt ggttactact   960
gaatgggcta tgtacgaatt ggccaaacat caatctgttc aagatagatt attcaaagaa  1020
atccaatccg tctgcggtgg tgaaaagatc aaagaagaac aattgccaag attgccttac  1080
gtcaatggtg tttttcacga aaccttgaga aagtattctc cagctccatt ggttccaatt  1140
agatacgctc atgaagatac ccaaattggt ggttatcata ttccagccgg ttctgaaatt  1200
gccattaaca tctacggttg caacatggat aagaagagat gggaaagacc tgaagaatgg  1260
tggccagaaa gattttttgga agatagatac gaatcctccg acttgcataa gactatgcat  1320
tttggtgctg gtaaaagagt ttgtgctggt gctttacaag ctagtttgat ggctggtatt  1380
gctatcggta gattggttca agaattcgaa tggaagttga gagatggtga agaagaaac   1440
gttgatactt acggtttgac ctcccaaaag ttgtatccat gatgccat tatcaaccca   1500
agaagatctt aa                                                      1512

SEQ ID NO: 253
MASMISLLLG FVVSSFLFIF FLKKLLFFFS RHKMSEVSRL PSVPVPGFPL IGNLLQLKEK    60
KPHKTFTKWS ELYGPIYSIK MGSSSLIVLN SIETAKEAMV SRFSSISTRK LSNALTVLTC   120
NKSMVATSDY DDFHKVKRC LLNGLLGANA QERKRHYRDA LIENVTSKLH AHTRNHPQEP    180
VNFRAIFEHE LFGVALKQAF GKDVESIYVK ELGVTLSRDE IFKVLVHDMM EGAIDVDWRD   240
FFPYLKWIPN NSFEARIQQK HKRRLAVMNA LIQDRLNQND SESDDDCYLN FLMSEAKTLT   300
MEQIAILVWE TIIETADTTL VTTEWAMYEL AKHQSVQDRL FKEIQSVCGG EKIKEEQLPR   360
LPYVNGVFHE TLRKYSPAPL VPIRYAHEDT QIGGYHIPAG SEIAINIYGC NMDKKRWERP   420
EEWWPERFLE DRYESSDLHK TMAFGAGKRV CAGALQASLM AGIAIGRLVQ EFEWKLRDGE   480
EENVDTYGLT SQKLYPLMAI INPRRS                                        506

SEQ ID NO: 254
aagcttacta gtaaaatgga catgatgggt attgaagctg ttccatttgc tactgctgtt    60
gttttggggtg gtatttcctt ggttgttttg atcttcatca gaagattcgt ttccaacaga   120
aagagatccg ttgaaggttt gccaccagtt ccagatattc caggttacc attgattggt     180
aacttgttgc aattgaaaga aaagaagcca cataagacct tgctagatg ggctgaaact    240
tacggtccaa ttttctctat tagaactggt gcttctacca tgatcgtctt gaattcttct   300
gaagttgcca agaagctat ggtcactaga ttctcttcaa tctctaccag aaagttgtcc    360
aacgccttga gattttgac cttcgataag tgtatggttg ccacctctga ttacaacgat   420
tttcacaaaa tggtcaaggg tttcatcttg agaaacgttt aggtgctcc agcccaaaaa    480
```

TABLE 3-continued

Sequences disclosed herein.

```
agacatagat gtcatagaga taccttgatc gaaaacatct ctaagtactt gcatgcccat    540
gttaagactt ctccattgga accagttgtc ttgaagaaga ttttcgaatc cgaaattttc    600
ggtttggctt tgaaacaagc cttgggtaag gatatcgaat ccatctatgt tgaagaattg    660
ggtactacct tgtccagaga agaaattttt gccgtttggg ttgttgatcc aatggctggt    720
gctattgaag ttgattggag agattttttc ccatacttgt cctggattcc aaacaagtct    780
atggaaatga agatccaaag aatggatttt agaagaggtg ctttgatgaa ggccttgatt    840
ggtgaacaaa agaaaagaat cggttccggt gaagaaaaga actcctacat tgatttcttg    900
ttgtctgaag ctaccacttt gaccgaaaag caaattgcta tgttgatctg ggaaaccatc    960
atcgaaattt ccgatacaac tttggttacc tctgaatggg ctatgtacga attggctaaa   1020
gacccaaata gacaagaaat cttgtacaga gaatccacca aggtttgcgg ttctaacaag   1080
ttgactgaag aaaacttgtc caagttgcca tacttgaact ctgttttcca cgaaaccttg   1140
agaaagtatt ctccagctcc aatggttcca gttagatatg ctcatgaaga tactcaattg   1200
ggtggttacc atattccagc tggttctcaa attgccatta acatctacgg ttgcaacatg   1260
aacaaaaagc aatgggaaaa tcctgaagaa tggaagccag aaagattctt ggacgaaaag   1320
tatgacttga tggacttgca taagactatg gcttttggtg gtggtaaaag agtttgtgct   1380
ggtgctttac aagcaatgtt gattgcttgc acttccatcg gtagattcgt tcaagaattt   1440
gaatggaagt tgatgggtgg tgaagaagaa aacgttgata ctgttgcttt gacctcccaa   1500
aaattgcatc caatgcaagc cattattaag gccagagaat gactcgagcc gcgg         1554

SEQ ID NO: 255
MDMMGIEAVP FATAVVLGGI SLVVLIFIRR FVSNRKRSVE GLPPVPDIPG LPLIGNLLQL    60
KEKKPHKTFA RWAETYGPIF SIRTGASTMI VLNSSEVAKE AMVTRFSSIS TRKLSNALKI   120
LTFDKCMVAT SDYNDFHKMV KGFILRNVLG APAQKRHRCH RDTLIENISK YLHAHVKTSP   180
LEPVVLKKIF ESEIFGLALK QALGKDIESI YVEELGTTLS REEIFAVLVV DPMAGAIEVD   240
WRDFFPYLSW IPNKSMEMKI QRMDFRRGAL MKALIGEQKK RIGSGEEKNS YIDFLLSEAT   300
TLTEKQIAML IWETIIEISD TTLVTSEWAM YELAKDPNRQ EILYREIHKV CGSNKLTEEN   360
LSKLPYLNSV FHETLRKYSP APMVPVRYAH EDTQLGGYHI PAGSQIAINI YGCNMNKKQW   420
ENPEEWKPER FLDEKYDLMD LHKTMAFGGG KRVCAGALQA MLIACTSIGR FVQEFEWKLM   480
GGEEENVDTV ALTSQKLHPM QAIIKARE                                      508

SEQ ID NO: 256
aagcttaaaa tgagtaagtc taatagtatg aattctacat cacacgaaac ccttttttcaa    60
caattggtct tgggtttgga ccgtatgcca ttgatggatg ttcactggtt gatctacgtt   120
gctttcggcg catggttatg ttcttatgtg atacatgttt tatcatcttc ctctacagta   180
aaagtgccag ttgttggata caggtctgta ttcgaaccta catggttgct tagacttaga   240
ttcgtctggg aaggtggctc tatcataggt caagggtaca ataagtttaa agactctatt   300
ttccaagtta ggaaattggg aactgatatt gtcattatac cacctaacta tattgatgaa   360
gtgagaaaat tgtcacagga caagactaga tcagttgaac cttctcattaa tgattttgca   420
ggtcaataca caagaggcat ggttttcttg caatctgact acaaaaccg tgttatacaa    480
caaagactaa ctccaaaatt ggtttccttg accaaggtca tgaaggaaga gttggattat   540
gctttaacaa aagagatgcc tgatatgaaa aatgacgaat gggtagaagt agatatcagt   600
agtataatgg tgagattgat ttccaggatc tccgccagag tctttctagg gcctgaacac   660
tgtcgtaacc aggaatggtt gactactaca gcagaatatt cagaatcact tttcattaca   720
gggtttatct taagagttgt acctcatatc ttaagactaa tcatcgcccc tctattacct   780
tcatacagga ctctacttag aaacgtttca agtggtagaa gagtcatcgg tgacatcata   840
agatctcagc aaggggatgg taacgaagat atactttcct ggatgagaga tgctgccaca   900
ggagaggaaa agcaaatcga taacattgct cagagaatgt taattcttc tttagcatca    960
atccacacta ctgcgatgac catgacacat gccatgtacg atctatgtgc ttgccctgag   1020
tacattgaac cattaagaga tgaagttaaa tctgttgttg gggcttctgg ctgggacaag   1080
acagcgttaa acagatttca taagttggac tccttcctaa aagagtcaca aagattcaac   1140
ccagtattct tattgacatt caatagaatc taccatcaat ctatgacctt atcagatggc   1200
actaacattc catctggaac acgtaatgct gttccatcac acgcaatgt gcaagattcc   1260
gcacatgtcc caggtccaac cccacctact gaatttgatg gattcagata tagtaagata   1320
cgttctgata gtaactacgc acaaaagtac ctattctcca tgaccgattc ttcaaacatg   1380
gctttcggat acggcaagta tgcttgtcca ggtagatttt acgcgtctaa tgagatgaaa   1440
ctaacattag ccattttgtt gctacaattt gagttcaaac taccagatgg taaaggtcgt   1500
cctagaaata tcactatcga ttctgatatg attccagacc caagagctag actttgcgtc   1560
agaaaaagat cacttagaga tgaatgaccg cgg                                1593

SEQ ID NO: 257
MSKSNSMNST SHETLFQQLV LGLDRMPLMD VHWLIYVAFG AWLCSYVIHV LSSSSTVKVP    60
VVGYRSVFEP TWLLRLRFVW EGGSIIGQGY NKFKDSIFQV RKLGTDIVII PPNYIDEVRK   120
LSQDKTRSVE PFINDFAGQY TRGMVFLQSD LQNRVIQQRL TPKLVSLTKV MKEELDYALT   180
KEMPDMKNDE WVEVDISSIM VRLISRISAR VFLGPEHCRN QEWLTTTAEY SESLFITGFI   240
LRVVPHILRP FIAPLLPSYR TLLRNVSSGR RVIGDIIRSQ QGDGNEDILS WMRDAATGEE   300
KQIDNIAQRM LILSLASIHT TAMTMTHAMY DLCACPEYIE PLRDEVKSVV GASGWDKTAL   360
NRFHKLDSFL KESQRFNPVF LLTFNRIYHQ SMTLSDGTNI PSGTRIAVPS HAMLQDSAHV   420
PGPTPPTEFD GFRYSKIRSD SNYAQKYLFS MTDSSNMAFG YGKYACPGRF YASNEMKLTL   480
AILLLQFEFK LPDGKGRPRN ITIDSDMIPD PRARLCVRKR SLRDE                   525

SEQ ID NO: 258
aagcttaaaa tggaagatcc tactgtctta tatgcttgtc ttgccattgc agttgcaact    60
ttcgttgtta gatggtacag agatccattg agatccatcc caacagttga tggttccatt   120
ttgcctattc tatcttacat cggcgcacta agatggacaa gacgtggcag agagatactt   180
caagagggat atgatggcta cagaggatct acattcaaaa tcgcgatgtt agaccgttgg   240
atcgtgatcg caaatggtcc taaactagct gatgaagtca gacgtagacc agatgaagag   300
ttaaactta tggacggatt aggagcattc gtccaaacta gtacacctt aggtgaagct   360
attcataacg atccatacca tgtcgatatc ataagagaaa aactaacaag aggccttcca   420
```

TABLE 3-continued

Sequences disclosed herein.

```
gccgtgcttc ctgatgtcat tgaagagttg acacttgcgg ttagacagta cattccaaca    480
gaaggtgatg aatgggtgtc cgtaaactgt tcaaaggccg caagagatat tgttgctaga    540
gcttctaata gagtctttgt aggtttgcct gcttgcagaa accaaggtta cttagatttg    600
gcaatagact ttacattgtc tgttgtcaag gatagagcca tcatcaatat gtttccagaa    660
ttgttgaagc caatagttgg cagagttgta ggtaacgcca ccagaaatgt tcgtagagct    720
gttccttttg ttgctccatt ggtggaggaa agacgtagac ttatggaaga gtacggtgaa    780
gactggtctg aaaaacctaa tgatatgtta cagtggataa tggatgaagc tgcatccaga    840
gatagttcag tgaaggcaat cgcagagaga ttgttaatgg tgaacttcgc ggctattcat    900
acctcatcaa acactatcac tcatgctttt taccaccttg ccgaaatgcc tgaaactttg    960
caaccactta gagaagagat cgaaccatta gtcaaagagg agggctggac caaggctgct   1020
atgggaaaaa tgtggtggtt agattcattt ctaagagaat ctcaaagata caatggcatt   1080
aacatcgtat ctttaactag aatggctgac aaagatatta cattgagtga tgcacatttt   1140
ttgccaaaag gtactctagt ggccgttcca gcgtattcta ctcatagaga tgatgctgtc   1200
tacgctgatg ccttagtatt cgatcctttc agattctcac gtatgagagc gagagaaggt   1260
gaaggtacaa agcaccagtt cgttaatact tcagtcgaaa acgttccatt tggtcacgga   1320
aagcatgctt gtccaggaag attcttcgcc gcaaacgaat tgaaagcaat gttggcttac   1380
attgttctaa actatgatgt aaagttgcct ggtgacggta aacgtccatt gaacatgtat   1440
tggggtccaa cagttttgcc tgcaccagca ggccaagtat tgttcagaaa gagacaagtt   1500
agtctataac cgcgg                                                     1515

SEQ ID NO: 259
MEDPTVLYAC LAIAVATFVV RWYRDPLRSI PTVGGSDLPI LSYIGALRWT RRGREILQEG     60
YDGYRGSTFK IAMLDRWIVI ANGPKLADEV RRRPDEELNF MDGLGAFVQT KYTLGEAIHN    120
DPYHVDIIRE KLTRGLPAVL PDVIEELTLA VRQYIPTEGD EWVSVNCSKA ARDIVARASN    180
RVFVGLPACR NQGYLDLAID FTLSVVKDRA IINMFPELLK PIVGRVVGNA TRNVRRAVPF    240
VAPLVEERRR LMEEYGEDWS EKPNDMLQWI MDEAASRDSS VKAIAERLLM VNFAAIHTSS    300
NTITHALYHL AEMPETLQPL REEIEPLVKE EGWTKAAMGK MWWLDSFLRE SQRYNGINIV    360
SLTRMADKDI TLSDGTFLPK GTLVAVPAYS THRDDAVYAD ALVFDPFRFS RMRAREGEGT    420
KHQFVNTSVE YVPFGHGKHA CPGRFFAANE LKAMLAYIVL NYDVKLPGDG KRPLNMYWGP    480
TVLPAPAGQV LFRKRQVSL                                                 499

SEQ ID NO: 260
atggcatttt tctctatgat ttcaattttg ttgggatttg ttatttcttc tttcatcttc     60
atctttttct tcaaaaagtt acttagtttt agtaggaaaa acatgtcaga agtttctact    120
ttgccaagtg ttccagtagt gcctggtttt ccagttattg ggaatttgtt gcaactaaag    180
gagaaaaagc ctcataaaac tttcactaga tggtcagaa tatatggacc tatctctct    240
ataaagatgg gttcttcatc tcttattgta ttgaacagta cagaaactgc taaggaagca    300
atggtcacta gatttcatc aatatctacc agaaaattgt caaacgccct aacagttcta    360
acctgcgata agtctatggt cgccacttct gattatgatg acttccacaa attagttaag    420
agatgttggc taaatggact tcttggtgct aatgctcaaa agagaaaaag acactacaga    480
gatgctttga ttgaaaatgt gagttccaag ctacatgcac acgctagaga tcatccacaa    540
gagccagtta actttagagc aattttcgaa cacgaattgt ttggtgtagc attaaagcaa    600
gccttcggta aagacgtaga atccatatac gtcaaggagt taggcgtaac attatcaaaa    660
gatgaaatct ttaaggtgct tgtacatgat atgatggagg gtgcaattga tgtagattgg    720
agagatttct tcccatattt gaaatggatc cctaataagt cttttgaagc taggataaaa    780
caaaagcaca agagaagact agctgttatg aacgcactta tacaggacag attgaagcaa    840
aatgggtctg aatcagatga tgattgttac cttaacttct taatgtctga ggctaaaaca    900
ttgactaagg aacagatcgc aatccttgtc tgggaaacaa tcattgaaac agcagatct    960
accttagtca caactgaatg ggccatatac gagctagcca aacatccatc tgtgcaagat   1020
aggttgtgta aggagatcca aacgtgtgt ggtggagaga aattcaagga agagcagttg   1080
tcacaagttc cttaccttaa cggcgttttc catgaaacct tgagaaaata ctcacctgca   1140
ccattagttc ctattagata cgcccacgaa gatcacaaa tggctggcta ccatgttcca   1200
gctgggtccg aaaattgctat aaacatctac gggtgcaaca tggacaaaaa gagatgggaa   1260
agaccagaag attggtggcc agaaagattc ttagatgatg gcaaaatga aacatctgat   1320
ttgcataaaa caatggcttt cggagctggc aaaagagtgt gtgccggtgc tctacaagcc   1380
tccctaatgg ctggtatcgc tattggtaga ttggtccaag agttcgaatg gaaacttaga   1440
gatggtgaag aggaaaatgt cgatacttat ggttaacat ctcaaaagtt atcccacta   1500
atggcaatca tcaatcctag aagatcctaa                                   1530

SEQ ID NO: 261
MAFFSMISIL LGFVISSFIF IFFFKKLLSF SRKNMSEVST LPSVPVVPGF PVIGNLLQLK     60
EKKPHKTFTR WSEIYGPIYS IKMGSSSLIV LNSTETAKEA MVTRFSSIST RKLSNALTVL    120
TCDKSMVATS DYDDFHKLVK RCLLNGLLGA NAQKRKRHYR DALIENVSSK LHAHARDHPQ    180
EPVNFRAIFE HELFGVALKQ AFGKDVESIY VKELGVTLSK DEIFKVLVHD MMEGAIDVDW    240
RDFFPYLKWI PNKSFEARIQ QKHKRRLAVM NALIQDRLKQ NGSESDDDCY LNFLMSEAKT    300
LTKEQIAILV WETIIETADT TLVTTEWAIY ELAKHPSVQD RLCKEIQNVC GGEKFKEEQL    360
SQVPYLNGVF HETLRKYSPA PLVPIRYAHE DTQIGGYHVP AGSEIAINIY GCNMDKKRWE    420
RPEDWWPERF LDDGKYETSD LHKTMAFGAG KRVCAGALQA SLMAGIAIGR LVQEFEWKLR    480
DGEEENVDTY GLTSQKLYPL MAIINPRRS                                      509

SEQ ID NO: 262
atgcaatcag attcagtcaa agtctctcca tttgatttgg tttccgctgc tatgaatggc     60
aaggcaatgg aaaagttgaa cgctagtgaa tctgaagatc caacaacatt gcctgcacta    120
aagatgctag ttgaaaatag agaattgttg acactgttca caacttcctt cgcagttctt    180
attgggtgtc ttgtatttct aatgtggaga cgttcatcct ctaaaaagct ggtacaagat    240
ccagttccac aagttatcgt tgtaaagaag aagagaagg agtcagaggt tgatgacggg    300
aaaaagaaag tttctatttt ctacggcaca caaacaggaa ctgccgaagg ttttgctaaa    360
gcattagtcg aggaagcaaa agtgagatat gaaaagacct ctttcaaggt tatcgatcta    420
```

TABLE 3-continued

Sequences disclosed herein.

```
gatgactacg ctgcagatga tgatgaatat gaggaaaaac tgaaaaagga atccttagcc   480
ttcttcttct tggccacata cggtgatggt gaacctactg ataatgctgc taacttctac   540
aagtggttca cagaaggcga cgataaaggt gaatggctga aaaagttaca atacggagta   600
tttggtttag gtaacagaca atatgaacat ttcaacaaga tcgctattgt agttgatgat   660
aaacttactg aaatgggagc caaaagatta gtaccagtag gattagggga tgatgatcag   720
tgtatagaag atgacttcac cgcctggaag gaattggtat ggccagaatt ggatcaactt   780
ttaaggacg aagatgatac ttctgtgact accccataca ctgcagccgt attggagtac   840
agagtggttt accatgataa accagcagac tcatatgctg aagatcaaac ccatacaaac   900
ggtcatgttg ttcatgatgc acagcatcct tcaagatcta atgtggcttt caaaaaggaa   960
ctacacacct tcaatcaga taggtcttgt actcacttag aattcgatat ttctcacaca  1020
ggactgtctt acgaaactgg cgatcacgtt ggcgtttatt ccgagaactt gtccgaagtt  1080
gtcgatgaag cactaaaact gttagggtta tcaccagaca catacttctc agtccatgct  1140
gataaggagg atgggacacc tatcggtggt gcttcactac caccacccttt tcctccttgc  1200
acattgagag acgctctaac cagatacgca gatgtctat cctcacctaa aaaggtagct  1260
ttgctggcat tggctgctca tctagtgaag ccgataggt aaagttcctg  1320
gcttcaccag ccgaaaaga tgaatatgca caatggatcg tcgccaacca acgttctttg  1380
ctagaagtga tgcaaagttt tccatctgcc aagcctccat taggtgtgtt cttcgcagca  1440
gtagctccac gtttacaacc aagatactac tctatcagtt catctcctaa gatgtctcct  1500
aacagaatac atgttacatg tgcttttggtg tacgagacta ctccagcagg cagaattcac  1560
agaggattgt gttcaacctg gatgaaaaat gctgtccctt taacagagtc acctgattgc  1620
tctcaagcat ccatttcgt tagaacatca aatttcagac ttccagtgga tccaaaagtt  1680
ccagtcatta tgataggacc aggcactggt cttgccccat tcaggggctt tcttcaagag  1740
agattggcct tgaaggaatc tggtacagaa ttgggttcct ctatcttttt ctttggttgc  1800
cgtaatagaa aagttgactt tatctacgag gacgagctta acaattttgt tgagacagga  1860
gcattgtcag aattgatcgt cgcattttca agagaaggga ctgccaaaga gtacgttcag  1920
cacaagatga gtcaaaaagc ctccgatata tggaaacttc taagtgaagg tgcctatctt  1980
tatgtctgtg gcgatgcaaa gggcatggcc aaggatgtcc atagaactct gcatacaatt  2040
gttcaggaac aagggagtct ggattcttcc aaggctgaat tgtacgtcaa aaacttacag  2100
atgtctggaa gatacttaag agatgtttgg taa                               2133

SEQ ID NO: 263
MQSDSVKVSP FDLVSAAMNG KAMEKLNASE SEDPTTLPAL KMLVENRELL TLFTTSFAVL    60
IGCLVFLMWR RSSSKKLVQD PVPQVIVVKK KEKESEVDDG KKKVSIFYGT QTGTAEGFAK   120
ALVEEAKVRY EKTSFKVIDL DDYAADDDEY EEKLKKESLA FFFLATYGDG EPTDNAANFY   180
KWFTEGDDKG EWLKKLQYGV FGLGNRQYEH FNKIAIVVDD KLTEMGAKRL VPVGLGDDDQ   240
CIEDDFTAWK ELVWPELDQL LRDEDDTSVT TPYTAAVLEY RVVYHDKPAD SYAEDQTHTN   300
GHVVHDAQHP SRSNVAFKKE LHTSQSDRSC THLEFDISHT GLSYETGDHV GVYSENLSEV   360
VDEALKLLGL SPDTYFSVHA DKEDGTPIGG ASLPPPFPPC TLRDALTRYA DVLSSPKKVA   420
LLALAAHASD PSEADRLKFL ASPAGKDEYA QWIVANQRSL LEVMQSFPSA KPPLGVFFAA   480
VAPRLQPRYY SISSSPKMSP NRIHVTCALV YETTPAGRIH RGLCSTWMKN AVPLTESPDC   540
SQASIFVRTS NFRLPVDPKV PVIMIGPGTG LAPFRGFLQE RLALKESGTE LGSSIFFFGC   600
RNRKVDFIYE DELNNFVETG ALSELIVAFS REGTAKEYVQ HKMSQKASDI WKLLSEGAYL   660
YVCGDAKGMA KDVHRTLHTI VQEQGSLDSS KAELYVKNLQ MSGRYLRDVW              710

SEQ ID NO: 264
atgaaggtca gtccattcga attcatgtcc gctattatca agggtagaat ggacccatct    60
aactcctcat ttgaatctac tggtgaagtt gcctccgtta tctttgaaaa cagagaattg   120
gttgccatct tgaccacttc tattgctgtt atgattggtt gcttcgttgt cttgatgtgg   180
agaagagctg gttctagaaa ggttaagaat gtcgaattgc caaagccatt gattgtccat   240
gaaccagaac ctgaagttga agatggtaag aagaaggttt ccatcttctt cggtactcaa   300
actggtactg ctgaaggttt tgctaaggct ttggctgatg aagctaaagc tagatacgaa   360
aaggctacct tcagagttgt tgatttggat gattatgctg ccgatgatga ccaatacgaa   420
gaaaaattga agaacgaatc cttcgccgtt ttccttgttg gctacttatg tgatggtgaa   480
cctactgata tgctgctag attttacaag tggttcgccg aaggtaaaga aagaggtgaa   540
tggttgcaaa acttgcacta tgctgttttt ggtttgggta acagacaata cgaacacttc   600
aacaagatcg ctaaggttgc cgacgaatta ttggaagctc aaggtggtaa tagattggtt   660
aaggttggtt taggtgatga cgatcaatgc atcgaagata attttctgc ttggagagaa   720
tctttgtggc cagaattgga tatgttgttg agagatgaag atgatgctac tactgttact   780
actccatata ctgctgctgt cttggaatac agagttgtct ttcatgattc tgctgatgtt   840
gctgctgaag ataagtcttg gattaacgct aatggtcatg ctgttcatga tgctcaacat   900
ccattcagat ctaacgttgt cgtcagaaaa gaattgcata cttctgcctc tgatagatcc   960
tgttctcatt tggaattcaa catttccggt tccgctttga attacgaaac tggtgatcat  1020
gttggtgtct actgtgaaaa cttgactgaa actgttgatg aagccttgaa cttgttgggt  1080
ttgtctccag aaacttactt ctctatctac accgataacg aagatggtac tccattgggt  1140
ggttcttcat tgccaccacc atttccatca tgtacttga gaactgctcttt gaccagatac  1200
gctgatttgt tgaactctcc aaaaaagtct gctttgttgg ctttagctgc tcatgcttct  1260
aatccagttg aagctgatag attgagatac ttggcttctc cagctggtaa agatgaatat  1320
gcccaatctg ttatcggttc ccaaaagtct ttgttggaag ttatggctga attcccatct  1380
gctaaaccac cattaggtgt ttttttttgct gctgttgctc caagattgca acctagattc  1440
tactccattt catcctctcc aagaatggct ccatctagaa tccatgttac ttgtgctttt  1500
gtttacgata agatgccaac tggtagaatt cataaggggtg tttgttctac ctggatgaag  1560
aattctgttc caatgaaaaa gtcccatgaa tgttcttggg ctccaatttt cgttagacaa  1620
tcccttttta agttgccagc cgaatccaag gttcaatta tcatggttgg tccaggtact  1680
ggtttggctc cttttagagg ttttttacaa gaaagattgg ccttgaaaga atccggtgtt  1740
gaattgggtc catccatttt gttttttcggt tgcagaaaca gaagaatgga ttacatctac  1800
gaagatgaat tgaacaactt cgttgaaacc ggtgctttgt ccgaattggt tattgctttt  1860
tctagagaag gtcctaccaa agaatacgtc aacataaga tggctgaaaa ggcttctgat  1920
atctggaact tgatttctga aggtgcttac ttgtacgttt gtggtgatgc taaaggtatg  1980
```

TABLE 3-continued

Sequences disclosed herein.

```
gctaaggatg ttcatagaac cttgcatacc atcatgcaag aacaaggttc tttggattct   2040
tccaaagctg aatccatggt caagaacttg caaatgaatg gtagatactt aagagatgtt   2100
tggtaa                                                               2106

SEQ ID NO: 265
MKVSPFEFMS AIIKGRMDPS NSSFESTGEV ASVIFENREL VAILTTSIAV MIGCFVVLMW     60
RRAGSRKVKN VELPKPLIVH EPEPEVEDGK KKVSIFFGTQ TGTAEGFAKA LADEAKARYE    120
KATFRVVDLD DYAADDDQYE EKLKNESFAV FLLATYGDGE PTDNAARFYK WFAEGKERGE    180
WLQNLHYAVF GLGNRQYEHF NKIAKVADEL LEAQGGNRLV KVGLGDDDQC IEDDFSAWRE    240
SLWPELDMLL RDEDDATTVT TPYTAAVLEY RVVFHDSADV AAEDKSWINA NGHAVHDAQH    300
PFRSNVVVRK ELHTSASDRS CSHLEFNISG SALNYETGDH VGVYCENLTE TVDEALNLLG    360
LSPETYFSIY TDNEDGTPLG GSSLPPPFPS CTLRTALTRY ADLLNSPKKS ALLALAAHAS    420
NPVEADRLRY LASPAGKDEY AQSVIGSQKS LLEVMAEFPS AKPPLGVFFA AVAPRLQPRF    480
YSISSSPRMA PSRIHVTCAL VYDKMPTGRI HKGVCSTWMK NSVPMEKSHE CSWAPIFVRQ    540
SNFKLPAESK VPIIMVGPGT GLAPFRGFLQ ERLALKESGV ELGPSILFFG CRNRRMDYIY    600
EDELNNFVET GALSELVIAF SREGPTKEYV QHKMAEKASD IWNLISEGAY LYVCGDAKGM    660
AKDVHRTLHT IMQEQGSLDS SKAESMVKNL QMNGRYLRDV W                        701

SEQ ID NO: 266
MEVTVASSVA LSLVFISIVV RWAWSVVNWV WFKPKKLERF LREQGLKGNS YRFLYGDMKE     60
NSILLKQARS KPMNLSTSHD IAPQVTPFVD QTVKAYGKNS FNWVGPIPRV NIMNPEDLKD    120
VLTKNVDFVK PISNPLIKLL ATGIAIYEGE KWTKHRRIIN PTFHSERLKR MLPSFHQSCN    180
EMVKEWESLV SKEGSSCELD VWPFLENMSA DVISRTAFGT SYKKGQKIFE LLREQVIYVT    240
KGFQSFYIPG WRFLPTKMNK RMNEINEEIK GLIRGIIIDR EQIIKAGEET NDDLLGALME    300
SNLKDIREHG KNNKNVGMSI EDVIQECKLF YFAGQETTSV LLAWTMVLLG QNQNWDRAR     360
QEVLQVFGSS KPDFDGLAHL KVVTMILLEV LRLYPPVIEL IRTIHKKTQL GKLSLPEGVE    420
VRLPTLLIHH DKELWGDDAN QFNPERFSEG VSKATKNRLS FPPFGAGPRI CIGQNFSMME    480
AKLALALILQ HFTFELSPSH AHAPSHRITL QPQYGVRIIL HRR                      523

SEQ ID NO: 267
atggaagcat caagggctag ttgtgttgcg ctatgtgttg tttgggtgag catagtaatt     60
acattggcat ggagggtgct gaattgggtg tggttgaggc caaagaaact agaaagatgc    120
ttgagggagc aaggccttac aggcaattct tacaggcttt tgtttggaga caccaaggat    180
ctctcgaaga tgctggaaca aacacaatcc aaacccatca aactctccac ctcccatgat    240
atagcgccac gagtcacccc atttttccat cgaactgtga actctaatgg caagaattct    300
tttgttttga tgggccctat atccaagagt gcacatcatga ttgaaagat                360
gccttcaaca gacatgatga ttttcataag acagtaaaaa atcctatcat gaagtctcca    420
ccaccgggca ttgtaggcat tgaaggtgag caatgggcta acacagaaa gattatcaac     480
ccagcattcc atttagagaa gctaaagggt atggtaccaa tattttacca aagttgtagc    540
gagatgatta acaaatggga gagcttggtg tccaaagaga gttcatgtga gttggatgtg    600
tggccttatc ttgaaaattt taccagcgat gtgatttccc gagctgcatt tggaagtagc    660
tatgaagagg gaaggaaaat atttcaacta ctaagagagg aagcaaaagt ttattcggta    720
gctctacgaa gtgtttacat tccaggatgg aggtttctac caaccaagca gaacaagaag    780
acgaaggaaa ttcacaatga aattaaaggc ttacttaagg gcattataaa taaaagggaa    840
gaggcgatga aggcagggga agccactaaa gatgacttac taggaatact tatggagtcc    900
aacttcaggg aaattcagga acatgggaac aacaaaaatg ctggaatgag tattgaagat    960
gtaattggag agtgtaagtt gttttacttt gctgggcaag agaccacttc ggtgttgctt   1020
gtttggacaa tgatttttact aagccaaaat caggattggc aagctcgtgc aagagagagg   1080
gtcttgaaag tctttggaag caacatccca acctatgaag agctaagtca cctaaaagtt   1140
gtgaccatga ttttacttga agttcttcga ttatacccat cagtcgttgc gcttcctcga   1200
accactcaca gaaaacacag ctggaaaa ttatcattac cagctggagt ggaagtctcc     1260
ttgcccatac tgcttgttca ccatgcaaaa gagttgtggg gtgaggatgc aaatgagttc   1320
aagccagaga ggttttcaga gggagtttca aaggcaacaa agaacaaatt tacatactta   1380
cctttcggag gggtccaagg gatttgcatt ggacaaaact ttgccatggt ggaagctaaa   1440
ttggccttgg ccctgatttt acaacacttt gcctttgagc tttctccatc ctatgctcat   1500
gctccttctg cagttataac ccttcaacct caatttggtg tcatatcat tttgcataaa    1560
cgttga                                                               1566

SEQ ID NO: 268
atggaagctt ctagagcatc ttgtgttgct ttgtgtgttg tttgggtttc catcgttatt     60
actttggctt ggagagtttt gaattgggtc tggttaagac caaaaaagtt ggaaagatgc    120
ttgagagaac aaggtttgac tggtaactct tacagattgt tgttcggtga taccaaggac    180
ttgtctaaga tgtggaaca aactcaatcc aagcctatca agtgtctac ctctcatgat      240
attgctccaa gagttactcc attcttccat agaactgtta actccaacgg taagaactct    300
tttgtttgga tgggtccaat tccaagagtc catattatga accctgaaga tttgaaggac    360
gctttcaaca gacatgatga tttccataag accgtcaaga acccaattat gaagtctcca    420
ccaccaggta tagttggtat tgaaggtgaa caatgggcca acatagaaa gattattaac     480
ccagccttcc acttggaaaa gttgaaaggt atggttccaa tcttctacca atcctgctct    540
gaaatgatta acaagtggga aatccttgtt tccaaagaat cttcctgtga attggatgtc    600
tggccatatt tggaaaactt cacctccgat gttatttcca gagctgcttt tggttcttct    660
tacgaagaag gtagaagat cttccaatta ttgagagagg aagccaaggt ttactccgtt    720
gctttggat ctgtttacat tccaggttgg agattcttgc caactaagca aaacaaaaag    780
accaagaaa tccacaacga aatcaagggt ttgttgaagg gtatcatcaa caagagagaa    840
gaagctatga aggctggtga agctacaaaa gatgatttgt tgggtatctt gatggaatcc    900
aacttcagag aaatccaaga aacggtaac aacaagaatg ccggtatgtc tattgaagat    960
gttatcggtg aatgcaagtt gttctacttt gctggtcaag aaactcctc gttttgttg    1020
gtttggacca tgattttgtt gtcccaaaat caagattggc aagctagagc tagagaagaa   1080
gtcttgaaag ttttcggttc taacatccca acctacgaag aattgtctca cttgaaggtt   1140
```

TABLE 3-continued

Sequences disclosed herein.

```
gtcactatga tcttgttgga agtattgaga ttatacccat ccgttgttgc attgccaaga   1200
actactcata agaaaactca attgggtaaa ttgtccttgc cagctggtgt tgaagtttct   1260
ttgccaattt tgttagtcca ccacgacaaa gaattgtggg gtgaagatgc taatgaattc   1320
aagccagaaa gattctccga aggtgtttct aaagctacca agaacaagtt cacttacttg   1380
ccatttggtg gtggtccaag aatatgtatt ggtcaaaatt tcgctatggt cgaagctaaa   1440
ttggctttgt ctttgatctt gcaacatttc gctttcgaat tgtccaccatc ttatgctcat   1500
gctccatctg ctgttattac attgcaacca caatttggtg cccatatcat cttgcataag   1560
agataac                                                              1567

SEQ ID NO: 269
MEASRASCVA LCVVWVSIVI TLAWRVLNWV WLRPKKLERC LREQGLTGNS YRLLFGDTKD    60
LSKMLEQTQS KPIKLSTSHD IAPRVTPFFH RTVNSNGKNS FVWMGPIPRV HIMNPEDLKD   120
AFNRHDDFHK TVKNPIMKSP PPGIVGIEGE QWAKHRKIIN PAFHLEKLKG MVPIFYQSCS   180
EMINKWESLV SKESSCELDV WPYLENFTSD VISRAAFGSS YEEGRKIFQL LREEAKVYSV   240
ALRSVYIPGW RFLPTKQNKK TKEIHNEIKG LLKGIINKRE EAMKAGEATK DDLLGILMES   300
NFREIQEHGN NKNAGMSIED VIGECKLFYF AGQETTSVLL VWTMILLSQN QDWQARAREE   360
VLKVFGSNIP TYEELSHLKV VTMILLEVLR LYPSVVALPR TTHKKTQLGK LSLPAGVEVS   420
LPILLVHHDK ELWGEDANEF KPERFSEGVS KATKNKFTYL PFGGGPRICI GQNFAMVEAK   480
LALALILQHF AFELSPSYAH APSAVITLQP QFGAHIILHK R                       521

SEQ ID NO: 270
ASWVAVLSVV WVSMVIAWAW RVLNWVWLRP KKLEKCLREQ GLAGNSYRLL FGDTKDLSKM    60
LEQTQSKPIK LSTSHDIAPH VTPFFHQTVN SYGKNSFVWM GPIPRVHIMN PEDLKDTFNR   120
HDDFHKVVKN PIMKSLPQGI VGIEGEQWAK HRKIINPAFH LEKLKGMVPI FYRSCSEMIN   180
KWESLVSKES SCELDVWPYL ENFTSDVISR AAFGSSYEEG RKIFQLLREE AKIYTVAMRS   240
VYIPGWRFLP TKQNKAKEI HNEIKGLLKG IINKREEAMK AGEATKDDLL GILMESNFRE   300
IQEHGNNKNA GMSIEDVIGE CKLFYFAGQE TTSVLLVWTM LLSQNQDWQ ARAREEVLQV   360
FGSNIPTYEE LSQLKVVTMI LLEVLRLYPS VVALPRTTHK KTQLGKLSLP AGVEVSLPIL   420
LVHHDKELWG EDANEFKPER FSEGVSKATK NQFTYPFGG GPRICIGQNF AMMEAKLALS   480
LILRHFALEL SPLYAHAPSV TITLQPQYGA HIILHKR                            517

SEQ ID NO: 271
MEASRPSCVA LSVVLVSIVI AWAWRVLNWV WLRPNKLERC LREQGLTGNS YRLLFGDTKE    60
ISMMVEQAQS KPIKLSTTHD IAPRVIPFSH QIVYTYGRNS FVWMGPTPRV TIMNPEDKD    120
AFNKSDEFQR AISNPIVKSI SQGLSSLEGE KWAKHRKIIN PAFHLEKLKG MLPTFYQSCS   180
EMINKWESLV FKEGSREMDV WPYLENLTSD VISRAAFGSS YEEGRKIFQL LREEAKFYTI   240
AARSVYIPGW RFLPTKQNKR MKEIHKEVRG LLKGIINKRE DAIKAGEAAK GNLLGILMES   300
NFREIQEHGN NKNAGMSIED VIGECKLFYF AGQETTSVLL VWTLVLLSQN QDWQARAREE   360
VLQVFGTNIP TYDQLSHLKV VTMILLEVLR LYPAVVELPR TTYKKTQLGK FLLPAGVEVS   420
LHIMLAHHDK ELWGEDAKEF KPERFSEGVS KATKNQFTYF PFGAGPRICI GQNFAMLEAK   480
LALSLILQHF TFELSPSYAH APSVTITLHP QFGAHFILHK R                       521

SEQ ID NO: 272
CVALSVVLVS IVIAWAWRVL NWVWLRPNKL ERCLREQGLT GNSYRLLFGD TKEISMMVEQ    60
AQSKPIKLST THDIAPRVIP FSHQIVYTYG RNSFVWMGPT PRVTIMNPED LKDAFNKSDE   120
FQRAISNPIV KSISQGLSSL EGEKWAKHRK IINPAFHLEK LKGMLPTFYQ SCSEMINKWE   180
SLVFKEGSRE MDVWPYLENL TSDVISRAAF GSSYEEGRKI FQLLREEAKF YTIAARSVYI   240
PGWRFLPTKQ NKRMKEIHKE VRGLLKGIIN KREDAIKAGE AAKGNLLGIL MESNFREIQE   300
HGNNKNAGMS IEDVIGECKL FYFAGQETTS VLLVWTLVLL SQNQDWQARA REEVLQVFGT   360
NIPTYDQLSH LKVVTMILLE VLRLYPAVVE LPRTTYKKTQ LGKFLLPAGV EVSLHIMLAH   420
HDKELWGEDA KEFKPERFSE GVSKATKNQF TYPFGAGPR ICIGQNFAML EAKLALSLIL   480
QHFTFELSPS YAHAPSVTIT LHPQFGAHFI LHKR                               514

SEQ ID NO: 273
MGPIPRVHIM NPEDLKDTFN RHDDFHKVVK NPIMKSLPQG IVGIEGDQWA KHRKIINPAF    60
HLEKLKGMVP IFYQSCSEMI NIWKSLVSKE SSCELDVWPY LENFTSDVIS RAAFGSSYEE   120
GRKIFQLLRE EAKVYTVAVR SVYIPGWRFL PTKQNKKTKE IHNEIKGLLK GIINKREEAM   180
KAGEATKDDL LGILMESNFR EIQEHGNNKN AGMSIEDVIG ECKLFYFAGQ ETTSVLLVWT   240
MVLLSQNQDW QARAREEVLQ VFGSNIPTYE ELSHLKVVTM ILLEVLRLYP SVVALPRTTH   300
KKTQLGKLSL PAGVEVSLPI LLVHHDKELW GEDANEFKPE RFSEGVSKAT KNQFTYPPFG   360
GGPRICIGQN FAMMEAKLAL SLILQHFTFE LSPQYSHAPS VTITLQPQYG AHLILHKR     418

SEQ ID NO: 274
atgggtttgt tcccattaga ggattcctac gcgctggtct ttgaaggact agcaataaca    60
ctggctttgt actatctact gtctttcatc tacaaaacat ctaaaaagac atgtacacct   120
cctaaagcat ctggtgaaat cattccaatt acaggaatca tattgaatct gctatctggc   180
tcaagtggtc tacctattat cttagcactt gcctctttag cagacagatg tggtcctatt   240
ttcaccatta ggctgggtat taggagagtg ctagtagtat caaattggga atcgctaag   300
gagattttca ctacccacga tttgatagtt tctaatagac caaaatactt agccgctaga   360
attcttggtt tcaattatgt ttcattctct ttcgctccat acggcccata ttgggtcgga   420
atcagaaaga ttattgctac aaaactaatg tcttcttcca gacttcagaa gttgcaattt   480
gtaagagttt tgaactagaa aaactctatg aaatctatca gagaatcatg gaaggagaaa   540
aaggatgaag agggaaaggt attagttgag atgaaaaagt ggtctgttga actgaattg   600
aacatagtgt taaggacagt tgctggtaaa caatacactg gtacagttga tgatgccgat   660
gcaaagcgta tctccgagtt attcagaaa tggtttcact acactggcag atttgtcgtt   720
ggagacgctt ttccttttct aggttggttg gacctgggcg gatacaaaaa gacaatggaa   780
ttagttgcta gtagattgga ctcaatggtc agtaaatggt tagatgagca tcgtaaaaag   840
caagctaacg atgacaaaaa ggaggatatg gatttcatgg atatcatgat ctccatgaca   900
```

TABLE 3-continued

Sequences disclosed herein.

```
gaagcaaatt caccacttga aggatacggc actgatacta ttatcaagac cacatgtatg   960
actttgattg tttcaggagt tgatacaacc tcaatcgtac ttacttgggc cttatcactt  1020
ttgttaaaca acagagatac tttgaaaaag gcacaagagg aattagatat gtgcgtaggt  1080
aaaggaagac aagtcaacga gtctgatctt gttaacttga tatacttgga agcagtgctt  1140
aaagaggctt taagacttta cccagcagcg ttcttaggcg gaccaagagc attcttggaa  1200
gattgtactg ttgctggtta tagaattcca aagggcacct gcttgttgat taacatgtgg  1260
aaactgcata gagatccaaa catttggagt gatccttgcg aattcaagcc agaaagattt  1320
ttgacaccta atcaaaagga tgttgatgtg atcggtatgg atttcgaatt gataccatttt 1380
ggtgccggca agatattg tccaggtact agattggctt tacagatgtt gcatatcgta  1440
ttagcgacat tgctgcaaaa cttcgaaatg tcaacaccaa acgatgcgcc agtcgatatg  1500
actgcttctg ttggcatgac aaatgccaaa gcatcacctt tagaagtctt gctatcacct  1560
cgtgttaaat ggtcctaa                                                1578

SEQ ID NO: 275
MGLFPLEDSY ALVFEGLAIT LALYYLLSFI YKTSKKTCTP PKASGEHPIT GHLNLLSGSS   60
GLPHLALASL ADRCGPIFTI RLGIRRVLVV SNWEIAKEIF TTHDLIVSNR PKYLAAKILG  120
FNYVSFSFAP YGPYWVGIRK IIATKLMSSS RLQKLQFVRV FELENSMKSI RESWKEKKDE  180
EGKVLVEMKK WFWELNMNIV LRTVAGKQYT GTVDDADAKR ISELFREWFH YTGRFVVGDA  240
FPFLGWLDLG GYKKTMELVA SRLDSMVSKW LDEHRKKQAN DDKKEDMDFM DIMISMTEAN  300
SPLEGYGTDT IIKTTCMTLI VSGVDTTSIV LTWALSLLLN NRDTLKKAQE ELDMCVGKGR  360
QVNESDLVNL IYLEAVLKEA LRLYPAAFLG GPRAFLEDCT VAGYRIPKGT CLLINMWKLH  420
RDPNIWSDPC EFKPERFLTP NQKDVDVIGM DFELIPFGAG RRYCPGTRLA LQMLHIVLAT  480
LLQNFEMSTP NDAPVDMTAS VGMTNAKASP LEVLLSPRVK WS                     522

SEQ ID NO: 276
atgatacaag ttttaactcc aattctactc ttcctcatct tcttcgtttt ctggaaagtc   60
tacaaacatc aaaagactaa aatcaatcta ccaccaggtt ccttcggctg gccattttg   120
ggtgaaacct tagccttact tagagcaggc tgggattctg agccagaaag attcgtaaga  180
gagcgtatca aaaagcatgg atctccactt gttttcaaga catcactatt ggagacaga   240
ttcgctgttc tttgcggtcc agctggtaat aagttttgt tctgcaacga aaacaaatta   300
gtggcatctt ggtggccagt ccctgtaagg aagttgttcg gtaaaagttt actcacaata  360
agaggagatg aagcaaaatg gatgagaaaa atgctattgt cttacttggg tccagatgca  420
tttgccacac attatgccgt tactatggat gttgtaacac gtagacatat tgatgtccat  480
tggagggcca aggaggaagt taatgtatt caaacagtta agttgtacgc attcgaatta   540
gcttgtagat tattcatgaa cctagatgac caaaccacat cgcgaaact cggtagtctt  600
ttcaacattt tcctcaaagg gatcatcgag cttcctatag acgttcctgg aactagattt   660
tactccagta aaaaggccgc agctgccatt agaattgaat tgaaaaagct cattaaagct  720
agaaaactcg aattgaagga gggtaaggcg tcttcttcac aggacttgct ttctcatcta  780
ttaacatcac ctgatgagaa tgggatgttc ttgacagaag aggaaatagt cgataacatt  840
ctacttttgt tattcgctgg tcacgatacc tctgcactat caataacact tttgatgaaa  900
accttaggtg aacacagtga tgtgtacgac aaggttttga aggaacaatt agaaatttcc  960
aaaacaaagg aggcttggga atcactaaag tgggaagata ccagaagat gaagtactca  1020
tggtcagtaa tctgtgaagt catgagattg aatcctcctg tcatagggac atacagagag  1080
gcgttggttg atatcgacta tgctggttac actatcccaa aaggatggaa gttgcattgg  1140
tcagctgttt ctactcaaag agacgaagcc aatttcgaag atgtaactag attcgatcca  1200
tccagatttg aaggggcagg ccctactcca ttcacatttg tgcctttcgg tggaggtcct  1260
agaatgtgtt taggcaaaga gtttgccagg ttagaagtgt tagcatttct ccacaacatt  1320
gttaccaact taagtgggga tcttctaatc cctgatgaga gatcgaaata tgatccaatg  1380
gctactccag ctaagggctt gccaattaga cttcatccac accaagtcta a           1431

SEQ ID NO: 277
MIQVLTPILL FLIFFVFWKV YKHQKTKINL PPGSFGWPFL GETLALLRAG WDSEPERFVR   60
ERIKKHGSPL VFKTSLFGDR FAVLCGPAGN KFLFCNENKL VASWWPVPVR KLFGKSLLTI  120
RGDEAKWMRK MLLSYLGPDA FATHYAVTMD VVTRRHIDVH WRGKEEVNVF QTVKLYAFEL  180
ACRLFMNLDD PNHIAKLGSL FNIFLKGIIE LPIDVPGTRF YSSKKAAAAI RIELKKLIKA  240
RKLELKEGKA SSSQDLLSHL LTSPDENGMF LTEEEIVDNI LLLLFAGHDT SALSITLLMK  300
TLGEHSDVYD KVLKEQLEIS KTKEAWESLK WEDIQKMKYS WSVICEVMRL NPPVIGTYRE  360
ALVDIDYAGY TIPKGWKLHW SAVSTQRDEA NFEDVTRFDP SRFEGAGPTP FTFVPFGGGP  420
RMCLGKEFAR LEVLAFLHNI VTNFKWDLLI PDEKIEYDPM ATPAKGLPIR LHPHQV     476

SEQ ID NO: 278
atggagtctt tagtggttca tacagtaaat gctatctggt gtattgtaat cgtcgggatt   60
ttctcagttg gttatcacgt ttacggtaga gctgtggtcg aacaatggag aatgagaaga  120
tcactgaagc tacaaggtgt taaaggccca ccaccatcca tcttcaatgg taacgtctca  180
gaaatgcaac gtatccaatc cgaagctaaa cactgctctg gcgataacat tatctcacat  240
gattattctt cttcattatt cccacacttc gatcactgga gaaaacagta cggcagaatc  300
tacacatact ctactggatt aaagcaacac ttgtacatca atcatccaga aatggtgaag  360
gagctatctc agactaacac attgaacttg gtagaatcac cccatataac caaaagattg  420
aatcctatct taggtaacgg aatcataacc tctaatgtc ctcattgggc ccatcagcgt   480
agaattatcg cctacgagtt tactcatgat aagatcaagg gtatggttgg tttgatggtt  540
gagtctgcta tgcctatgtt gaataagtgg gaggagatgg taaagagagg cggagaaatg  600
ggatgcgaca taagagttga tgaggacttg aaagatgttt cagcagatgt gattgcaaaa  660
gcctgtttga gatcctcatt ttctaaaggt aaggctattt tctctatgat aagagatttg  720
cttacagcta tcacaaagag aagtgttcta ttcagattca acggattcac tgatatggtc  780
tttggagta aaaagcatgg tgacgttgat atagacgctt tagaaatgga attggaatca  840
tccatttggg aaactgtcaa ggaacgtgaa atagaatgta agatactca caaaaaggat  900
ctgatgcaat tgattttgga aggggcaatg cgttcatgtg acggtaaccc tttgggataaa  960
tcagcatata gaagatttgt tgtagataat tgtaaatcta tctacttcgc agggcatgat  1020
```

TABLE 3-continued

Sequences disclosed herein.

```
agtacagctg tctcagtgtc atggtgtttg atgttactgg ccctaaaccc atcatggcaa   1080
gttaagatcc gtgatgaaat tctgtcttct tgcaaaaatg gtattccaga tgccgaaagt   1140
atcccaaacc ttaaaacagt gactatggtt attcaagaga caatgagatt atacctcca    1200
gcaccaatcg tcgggagaga agcctctaaa gatatcagat tgggcgatct agttgttcct   1260
aaaggcgtct gtatatggac actaatacca gctttacaca gagatcctga gatttgggga   1320
ccagatgcaa acgatttcaa accagaaaga ttttctgaag gaatttcaaa ggcttgtaag   1380
tatcctcaaa gttacattcc atttggtctg ggtcctagaa catgcgttgg taaaaacttt   1440
ggcatgatgg aagtaaaggt tcttgtttcc ctgattgtct ccaagttctc tttcactcta   1500
tctcctacct accaacaatag tcctagtcac aaacttttag tagaaccaca acatgggggtg  1560
gtaattagag tggtttaa                                                 1578

SEQ ID NO: 279
MESLVVHTVN AIWCIVIVGI FSVGYHVYGR AVVEQWRMRR SLKLQGVKGP PPSIFNGNVS     60
EMQRIQSEAK HCSGDNIISH DYSSSLFPHF DHWRKQYGRI YTYSTGLKQH LYINHPEMVK    120
ELSQTNTLNL GRITHITKRL NPILGNGIIT SNGPHWAHQR RIIAYEFTHD KIKGMVGLMV    180
ESAMPMLNKW EEMVKRGGEM GCDIRVDEDL KDVSADVIAK ACFGSSFSKG KAIFSMIRDL    240
LTAITKRSVL FRFNGFTDMV FGSKKHGDVD IDALEMELES SIWETVKERE IECKDTHKKD    300
LMQLILEGAM RSCDGNLWDK SAYRRFVVDN CKSIYFAGHD STAVSVSWCL MLLALNPSWQ    360
VKIRDEILSS CKNGIPDAES IPNLKTVTMV IQETMRLYPP APIVGREASK DIRLGDLVVP    420
KGVCIWTLIP ALHRDPEIWG PDANDFKPER FSEGISKACK YPQSYIPFGL GPRTCVGKNF    480
GMMEVKVLVS LIVSKFSFTL SPTYQHSPSH KLLVEPQHGV VIRVV                   525

SEQ ID NO: 280
atgtacttcc tactacaata cctcaacatc acaaccgttg gtgtctttgc cacattgttt     60
ctctcttatt gtttacttct ctggagaagt agagcgggta acaaaaagat tgccccagaa    120
gctgccgctg catggcctat tatcggccac ctccacttac ttgcaggtgg atcccatcaa    180
ctaccacata ttacattggg taacatggca gataagtacg gtcctgtatt cacaatcaga    240
ataggcttgc atagagctgt agttgtctca tcttgggaaa tggcaaagga atgttcaaca    300
gctaatgatc aagtgtcttc ttcaagacct gaactattag cttctaagtt gttgggttat    360
aactacgcca tgtttggttt ttcaccatac ggttcatact ggagagaaat gagaaagatc    420
atctctctcg aattactatc taattccaga ttggaactat tgaaagatgt tagagcctca    480
gaagttgtca catctattaa ggaactatac aaattgtggg cggaaaagaa gaatgagtca    540
ggattggttt ctgtcgagat gaaacaatgg ttcggagatt tgactttaaa cgtgatcttg    600
agaatggtgg ctggtaaaag atacttctcc gcgagtgacg cttcagaaaa caaacaggcc    660
cagcgttgta agagagtctt cagagaattc ttccatctct ccggcttgtt tgtggttgct    720
gatgctatac cttttcttgg atggctcgat tgggaagaac gcgagaagac cttgaaaag    780
accgccatag aaatggattc catcgcccag gagtggcttg aggaacatag acgtagaaaa    840
gattctggag atgataattc tacccaagat ttcatggacg ttatgcaatc tgtgctagat    900
ggcaaaaatc taggcggata cgatgctgat acgattaaca aggctacatg cttaactctt    960
atatcaggtg gcagtgatac tactgtagtt tctttgacat gggctcttag tcttgtgtta   1020
aacaatagaa atactttgaa aaaggcacag gaagagttga acatccaagt cggtaaggaa   1080
agattggtta acgagcaaga catcagtaag ttagtttact tgcaagcaat agtaaaagag   1140
acactcagac tttatccacc aggtcctttg gtggtttga gacaattcac tgaagattgt   1200
acactaggtg gctatcacgt ttcaaaagga actagattaa tcatgaactt atccaagatt   1260
caaaaagatc cacgtatttg gtctgatcct actgaattcc aaccagagag attccttacg   1320
actcataaag atgtcgatcc acgtggtaaa cactttgaat tcattccatt cggtgcagga   1380
agacgtgcat gtcctggtat cacattcgga ttacaagtac tacatctaac attggcatct   1440
ttcttgcatg cgtttgaatt tcaacacca tcaaatgagc aggttaacat gagagaatca   1500
ttaggtctta cgaatatgaa atctaccccca ttagaagttt tgatttctcc aagactatcc   1560
cttaattgct tcaaccttat gaaaatttga                                    1590

SEQ ID NO: 281
MYFLLQYLNI TTVGVFATLF LSYCLLLWRS RAGNKKIAPE AAAAWPIIGH LHLLAGGSHQ     60
LPHITLGNMA DKYGPVFTIR IGLHRAVVVS SWEMAKECST ANDQVSSSRP ELLASKLLGY    120
NYAMFGFSPY GSYWREMRKI ISLELLSNSR LELLKDVRAS EVVTSIKELY KLWAEKKNES    180
GLVSVEMKQW FGDLTLNVIL RMVAGKRYFS ASDASENKQA QRCRRVFREF PHLSGLFVVA    240
DAIPFLGWLD WGRHEKTLKK TAIEMDSIAQ EWLEEHRRRK DSGDDNSTQD FMDVMQSVLD    300
GKNLGGYDAD TINKATCLTL ISGGSDTTVV SLTWALSLVL NNRDTLKKAQ EELDIQVGKE    360
RLVNEQDISK LVYLQAIVKE TLRLYPPGPL GGLRQFTEDC TLGGYHVSKG TRLIMNLSKI    420
QKDPRIWSDP TEFQPERFLT THKDVDPRGK HFEFIPFGAG RRACPGITFG LQVLHLTLAS    480
FLHAFEFSTP SNEQVNMRES LGLTNMKSTP LEVLISPRLS SCSLYN                  526

SEQ ID NO: 282
atggaaccta acttttactt gtcattacta ttgttgttcg tgaccttcat ttctttaagt     60
ctgttttca tcttttacaa acaaaagtcc ccattgaatt tgccaccagg gaaaatgggt    120
taccctatca taggtgaaag tttagaattc ctatccacag gctggaaggg acatcctgaa    180
aagttcatat tgatagaat gcgtaagtac agtagtgagt tattcaagac ttctattgta    240
ggcgaatcca cagttgtttg ctgtggggca gctagtaaca aattcctatt ctctaacgaa    300
aacaaactgg taactgcctg gtggccagat tctgttaaca aaatcttccc aacaactca    360
ctggattcta atttgaagga ggaatctata aagatgagaa agttgctgcc acagttcttc    420
aaaccagaag cacttcaaag atacgtcggc gttatggatg taatcgcaca aagacatttt    480
gtcactcact gggacaacaa aaatgagatc acagtttatc cacttgctaa agatacact    540
ttcttgctg cgtgtagact gttcatgtct gttgaggatg aaaatcatgt ggcgaaattc    600
tcagacccat tccaactaat cgctgcaggc atcattcac ttcctatcga tcttcctggt    660
actccattca acaaggccat aaaggcttca aatttcatta gaaagagct gataaagatt    720
atccaaacaaa gacgtgttga tctggcagag ggtacagcat ctccaaccca ggatatcttg    780
tcacatatgc tattaacatc tgatgaaaac ggtaaatcta tgaacgagtt gaacattgcc    840
gacaagattc ttggactatt gataggaggc cacgatacag cttcagtagc ttgcacattt    900
```

TABLE 3-continued

Sequences disclosed herein.

```
ctagtgaagt acttaggaga attaccacat atctacgata aagtctacca agagcaaatg    960
gaaattgcca agtccaaacc tgctgggaa ttgttgaatt gggatgactt gaaaaagatg   1020
aagtattcat ggaatgtggc atgtgaggta atgagattgt caccaccttt acaaggtggt   1080
tttagagagg ctataactga ctttatgttt aacggtttct ctattccaaa agggtggaag   1140
ttatactggt ccgccaactc tacacacaaa aatgcagaat gtttcccaat gcctgagaaa   1200
ttcgatccta ccagatttga aggtaatggt ccagcgcctt atacatttgt accattcggt   1260
ggaggcccta gaatgtgtcc tggaaaggaa tacgctagat tagaaatctt ggttttcatg   1320
cataatctgg tcaaacgttt taagtgggaa aaggttattc cagacgaaaa gattattgtc   1380
gatccattcc caatcccagc taaagatctt ccaatccgtt tgtatcctca caaagcttaa   1440

SEQ ID NO: 283
MEPNFYLSLL LLFVTFISLS LFFIFYKQKS PLNLPPGKMG YPIIGESLEF LSTGWKGHPE     60
KFIFDRMRKY SSELFKTSIV GESTVVCCGA ASNKFLFSNE NKLVTAWWPD SVNKIFPTTS    120
LDSNLKEESI KMRKLLPQFF KPEALQRYVG VMDVIAQRHF VTHWDNKNEI TVYPLAKRYT    180
FLLACRLFMS VEDENHVAKF SDPFQLIAAG IISLPIDLPG TPFNKAIKAS NFIRKELIKI    240
IKQRRVDLAE GTASPTQDIL SHMLLTSDEN GKSMNELNIA DKILGLLIGG HDTASVACTF    300
LVKYLGELPH IYDKVYQEQM EIAKSKPAGE LLNWDDLKKM KYSWNVACEV MRLSPPLQGG    360
FREAITDFMF NGFSIPKGWK LYWSANSTHK NAECFPMPEK FDPTRFEGNG PAPYTFVPFG    420
GGPRMCPGKE YARLEILVFM HNLVKRFKWE KVIPDEKIIV DPFPIPAKDL PIRLYPHKA     479

SEQ ID NO: 284
atggctacat ctgattctat tgttgatgac aggaagcagt tgcatgtggc tactttccct     60
tggctttgctt tcggtcatat actgccttac ctacaactat caaaactgat agctgaaaaa    120
ggacataaag tgtcattcct ttcaacaact agaaacattc aaagattatc ttcccacata    180
tcaccattga ttaacgtcgt tcaattgaca cttccaagag tacaggaatt accagaagat    240
gctgaagcta aacagatgt gcatcctgaa gatatcccctt acttgaaaaa ggcatccgat    300
ggattacagc ctgaggtcac tagattcctt gagcaacaca gtccagattg gatcatatac    360
gactacactc actattggtt gccttcaatt gcagcatcac taggcatttc tagggcacat    420
ttcagtgtaa ccacaccttg gccattgct tacatgggtc catccgctga tgctatgatt    480
aacggcagtg atggtagaac taccgttgaa gatttgacaa ccccaccaaa gtggtttcca    540
tttccaacta aagtctgttg gagaaaacac gacttagcaa gactggttcc atacaaggca    600
ccaggaatct cagacgcta tagaatgggt ttagtcctta aagggtctga ctgcctattg    660
tctaagtgtt accatgagtt tgggacacaa tggctaccac ttttggaaac attacaccaa    720
gttcctgtcg taccagttgg tctattacct ccagaaatcc ctggtgatga aaggacgag    780
acttgggttt caatcaaaaa gtggttagac gggaagcaaa aaggctcagt ggtatatgtg    840
gcactgggtt ccgaagtttt agtatctcaa acagaagttg tggaacttgc cttaggtttg    900
gaactatctg gattgccatt tgtctgggcc tacagaaaac caaaaggccc tgcaaagtcc    960
gattcagttg aattgccaga cggctttgtc gagagaacta gagatagagg gttggtatgg   1020
acttcatggg ctccacaatt gagaatcctg agtcacgaat ctgtgtgcgg tttcctaaca   1080
cattgtggtt ctggttctat agttgaagga ctgatgtttg gtcatccact tatcatgttg   1140
ccaatctttg gtgaccagcc tttgaatgca cgtctgttag aagataaaca agttggaatt   1200
gaaatcccac gtaatgagga agatggatgt taaccaagg agtctgtggc cagatcatta   1260
cgttccgttg tcgttgaaaa ggaaggcgaa atctacaagg ccaatgcccg tgaactttca   1320
aagatctaca atgacacaaa agtagagaag gaatatgttt ctcaatttgt agattaccta   1380
gagaaaaacg ctagagccgt agctattgat catgaatcct aa                      1422

SEQ ID NO: 285
MATSDSIVDD RKQLHVATFP WLAFGHILPY LQLSKLIAEK GHKVSFLSTT RNIQRLSSHI     60
SPLINVVQLT LPRVQELPED AEATTDVHPE DIPYLKKASD GLQPEVTRFL EQHSPDWIIY    120
DYTHYWLPSI AASLGISRAH FSVTTPWAIA YMGPSADAMI NGSDGRTTVE DLTTPPKWFP    180
FPTKVCWRKH DLARLVPYKA PGISDGYRMG LVLKGSDCLL SKCYHEFGTQ WLPLLETLHQ    240
VPVVPVGLLP PEIPGDEKDE TWVSIKKWLD GKQKGSVVYV ALGSEVLVSQ TEVVELALGL    300
ELSGLPFVWA YRKPKGPAKS DSVELPDGFV ERTRDRGLVW TSWAPQLRIL SHESVCGFLT    360
HCGSGSIVEG LMFGHPLIML PIFGDQPLNA RLLEDKQVGI EIPRNEEDGC LTKESVARSL    420
RSVVVEKEGE IYKANARELS KIYNDTKVEK EYVSQFVDYL EKNARAVAID HES            473

SEQ ID NO: 286
atggcagaat tagatacact tgatatagta gtattaggtg ttatctttt gggtactgtg     60
gcatacttta ctaagggtaa attgtggggt gttaccaagg atccatacgc taacggattc    120
gctgcaggtg gtgcttccaa gcctggcaga actagaaaca tcgtcgaagc tatggaggaa    180
tcaggtaaaa actgtgttgt tttctacggc agtcaaacag taacagcgga ggattacgca    240
tcaagacttg caaaggaagg aaagtccaga ttccggtttga acactatgat cgccgatcta    300
gaagattatg acttcgataa cttagacact gttccatctg ataacatcgt tatgtttgta    360
ttggctactt acggtgaagg cgaaccaaca gataacgccg tggatttcta tgagttcatt    420
actggcgaag atgcctcttt caatgagggc aacgatcctc cactaggtaa cttgaattac    480
gttgcgttcg gtctgggcaa caatacctac gaacactaca actcaatggt caggaacgtt    540
aacaaggctc tagaaaagtt aggagctcat agaattggag aagcaggtga gggtgacgac    600
ggagctggaa ctatgaagaa ggacttttta gcttggaaag atccaatgtg ggaagccttg    660
gctaaaaaga tgggcttgga ggaaagaaa gctgtatatg aacctatttt cgctatcaat    720
gagagagatg atttgacccc tgaagcgaat gaggtatact gggagaacc taataagcta    780
cacttggaag gtacagcgaa aggtccattc aactcccaca acccatatat cgcaccaatt    840
gcagaatcat acgaactttt ctcagctaag atagaaatt gtctgcatat ggaaattgat    900
atttggtgta gtaatctaaa gtatgaaaca ggcgaccata tcgcgatctg gcctaccaac    960
ccaggtgaag aggtcaacaa atttcttgac attctagatc tgtctggtaa gcaacattcc   1020
gtcgtaacag tgaaagcctt agaacctaca gccaaagttc cttttccaaa tccaactacc   1080
tacgatgcta tattgagata ccatctgaa atatgcgctc cagttctag acagtttgtc    1140
tcaacttag cagcattcgc ccctaatgat gatatcaaag ctgagatgaa ccgtttggga   1200
tcagacaaag attacttcca cgaaaagaca ggaccacatt actacaatat cgctagattt   1260
```

TABLE 3-continued

Sequences disclosed herein.

```
ttggcctcag tctctaaagg tgaaaaatgg acaaagatac cattttctgc tttcatagaa   1320
ggcctttacaa aactacaacc aagatactat tctatctctt cctctagttt agttcagcct   1380
aaaaagatta gtattactgc tgttgtcgaa tctcagcaaa ttccaggtag agataccca    1440
ttcagaggtg tagcgactaa ctacttgttc gctttgaagc agaaacaaaa cggtgatcca   1500
aatccagctc cttttggcca atcatacgag ttgacaggac caaggaataa gtatgatggt   1560
atacatgttc cagtccatgt aagacattct aactttaagc taccatctga tccaggcaaa   1620
cctattatca tgatcggtcc aggtaccggt gttgcccctt ttagaggctt cgtccaagag   1680
agggcaaaac aagccagaga tggtgtagaa gttggtaaaa cactgctgtt ctttggatgt   1740
agaaagagta cagaagattt catgtatcaa aaagagtggc aagagtacaa ggaagctctt   1800
ggcgacaaat tcgaaatgat tacagctttt tcaagagaag gatctaaaaa ggtttatgtt   1860
caacacagac tgaaggaaag atcaaaggaa gttttctgatc ttctatccca aaaagcatac   1920
ttctacgttt gcggagacgc cgcacatatg gcacgtgaag tgaacactgt gttagcacag   1980
atcatagcag aaggccgtgg tgtatcgaaa gccaagggtg aggaaattgt caaaaacatg   2040
agatcagcaa atcaatacca agtgtgttct gatttcgtaa ctttacactg taaagagaca   2100
acatacgcga attcagaatt gcaagaggat gtctggagtt aa                      2142

SEQ ID NO: 287
MAELDTLDIV VLGVIFLGTV AYFTKGKLWG VTKDPYANGF AAGGASKPGR TRNIVEAMEE    60
SGKNCVVFYG SQTGTAEDYA SRLAKEGKSR FGLNTMIADL EDYDFDNLDT VPSDNIVMFV   120
LATYGEGEPT DNAVDFYEFI TGEDASFNEG NDPPLGNLNY VAFGLGNNTY EHYNSMVRNV   180
NKALELEKGAH RIGEAGEGDD GAGTMEEDFL AWKDPMWEAL AKKMGLEERE AVYEPIFAIN  240
ERDDLTPEAN EVYLGEPNKL HLEGTAKGPF NSHNPYIAPI AESYELFSAK DRNCLHMEID  300
ISGSNLKYET GDHIAIWPTN PGEEVNKFLD ILDLSGKQHS VVTVKALEPT AKVPFPNPTT  360
YDAILRYHLE ICAPVSRQFV STLAAFAPND DIKAEMNRLG SDKDYFHEKT GPHYYNIARF  420
LASVSKGEKW TKIPFSAFIE GLTKLQPRYY SISSSSLVQP KKISITAVVE SQQIPGRDDP  480
FRGVATNYLF ALKQKQNGDP NPAPFGQSYE LTGPRNKYDG IHVPVHVRHS NFKLPSDPGK  540
PIIMIGPGTG VAPFRGFVQE RAKQARDGVE VGKTLLFFGC RKSTEDFMYQ KEWQEYKEAL  600
GDKFEMITAF SREGSKKVYV QHRLKERSKE VSDLLSQKAY FYVCGDAAHM AREVNTVLAQ  660
IIAEGRGVSE AKGEEIVKNM RSANQYQVCS DFVTLHCKET TYANSELQED VWS         713

SEQ ID NO: 288
atgcaatcgg aatccgttga agcatcgacg attgatttga tgactgctgt tttgaaggac    60
acagtgatcg atacagcgaa cgcatctgat aacggagact caaagatgcc gccggcgttg   120
gcgatgatgt tcgaaattcg tgatctgttg ctgattttga ctacgtcagt tgctgttttg   180
gtcggatgtt tcgttgtttt ggtgtggaag agatcgtccg ggaagaagtc cggcaaggaa   240
ttggagccgc cgaagatcgt tgtgccgaag aggcggctgg agcaggaggt tgatgatggt   300
aagaagaagg ttacgatttt cttcggaaca caaactggaa cggctgaagg tttcgctaag   360
gcacttttcg aagaagcgaa agcgcgatat gaaaaggcag cgtttaaagt gattgatttg   420
gatgattatg ctgctgattt ggatgagtat gcagagaagc tgaagaagga aacatatgct   480
ttcttcttct tggctacata tggagatggt gagcaactga ataatgctgc caaatttttat   540
aaaatggttta ctgagggaga cgagaaaggc gtttggcttc aaaaaacttca atatggagta   600
tttggtcttg gcaacagaca atatgaacat ttcaacaaga ttggaatagt ggttgatgat   660
ggtctccaccg agcagggtgc aaaacgcatt gttcccgttg tcttggagga cgacgatcaa   720
tcaattgaag acgattttttc ggcatggaaa gagttagtgg ggccgaatt ggatctattg   780
cttcgcgatg aagatgacaa agctgctgca actccttaca cagctgcaat ccctgaatac   840
cgcgtcgtat ttcatgacaa acccgatgcg ttttctgatg atcatactca aaccaatggt   900
catgctgttc atgatgctca acatccatgc agatccaatg tggctgttaa aaaagagctt   960
catactcctg aatccgatcg ttcatgcaca catcttgaat ttgacatttc tcacactggta  1020
ttatcttatg aaactgggga tcatgttggt gtatactgtg aaaacctaat tgaagtagtg  1080
gaagaagctg ggaaattgtt aggattatca acagatactt atttctcgtt acatattgat  1140
aacgaagatg gttcaccact tggtggacct tcattacaac ctccttttcc tccttgtact  1200
ttaagaaaag cattgactaa ttatgcagat ctgttaagct ctcccaaaaa gtcaacttttg  1260
cttgctctag ctgctcatgc ttccgatccc actgaagctg atcgtttaag atttcttgca  1320
tctcgcgagg gcaaggatga atatgctgaa tgggttgttg caaaccaaag aagtcttcctt  1380
gaagtcatgg aagctttccc gtcagctaga ccgccacttg tgttttctt tgcagcggtt  1440
gcaccgcgtt tacagcctcg ttactactct atttcttcct ccccaaagat ggaaccaaac  1500
aggattcatg ttacttgcgc gttggttttat gaaaaaaactc ccgcaggtcg tatccacaaa  1560
ggaatctgct caacctggat gaagaacgct gtacctttga ccgaaagtca agattgcagt  1620
tgggcaccga ttttttgttag aacatcaaac ttcagacttc caattgaccc gaaagtcccg  1680
gttatcatga ttggtcctgg aaccggggttg gctccattta ggggttttct tcaagaaaga  1740
ttggctctta aagaatccgg aaccgaactc gggtcatcta tttattcctt cggttgtaga  1800
aaccgcaaag tggattacat atatgagaat gaactcaaca actttgttga aaatggtgcg  1860
cttttctgagc ttgatgttgc tttctcccgc gatggccccga cgaaagaata cgtgcaacat  1920
aaaatgaccc aaaaggcttc tgaaatatgg aatatgcttt ctgagggagc atatttatat  1980
gtatgtggtg atgctaaagg catgactaaa gatgtacacc gtacacttca caccattgtg  2040
caagaacagg gaagtttgga ctcgtctaaa gcggagttgt atgtgaagaa tctacaaatg  2100
tcaggaagat acctccgtga tgtttggtaa                                   2130

SEQ ID NO: 289
MQSESVEAST IDLMTAVLKD TVIDTANASD NGDSKMPPAL AMMFEIRDLL LILTTSVAVL    60
VGCFVVLVWK RSSGKKSGKE LEPPKIVVPK RRLEQEVDDG KKKVTIFFGT QTGTAEGFAK   120
ALFEEAKARY EKAAFKVIDL DDYAADLDEY AEKLKKETYA FFFLATYGDG EPTDNAAKFY   180
KWFTEGDEKG VWLQKLQYGV FGLGNRQYEH FNKIGIVVDD GLTEQGAKRI VPVGLGDDDQ   240
SIEDDFSAWK ELVWPELDLL LRDEDDKAAA TPYTAAIPEY RVVHDKPDA FSDDHTQTNG   300
HAVHDAQHPC RSNVAVKKEL HTPESDRSCT HLEFDISHTG LSYETGDHVG VYCENLIEVV   360
EEEAGKLLGLS TDTYFSLHID NEDGSPLGGP SLQPPFPPCT LRKALTNYAD LLSSPKKSTL   420
LALAAHASDP TEADRLRFLA SREGKDEYAE WVVANQRSLL EVMEAFPSAR PPLGVFFAAV   480
APRLQPRYYS ISSSPKMEPN RIHVTCALVY EKTPAGRIHK GICSTWMKNA VPLTESQDCS   540
```

TABLE 3-continued

Sequences disclosed herein.

```
WAPIFVRTSN FRLPIDPKVP VIMIGPGTGL APFRGFLQER LALKESGTEL GSSILFFGCR    600
NRKVDYIYEN ELNNFVENGA LSELDVAFSR DGPTKEYVQH KMTQKASEIW NMLSEGAYLY    660
VCGDAKGMAK DVHRTLHTIV QEQGSLDSSK AELYVKNLQM SGRYLRDVW                709

SEQ ID NO: 290
atgtcctcca actccgattt ggtcagaaga ttggaatctg ttttggggtgt ttctttcggt    60
ggttctgtta ctgattccgt tgttgttatt gctaccacct ctattgcttt ggttatcggt   120
gttttggttt tgttgtggag aagatcctct gacagatcta gagaagttaa gcaattggct   180
gttccaaagc cagttactat cgttgaagaa gaagatgaat cgaagttgc ttctggtaag    240
accagagttt ctattttcta cggtactcaa actggtactg ctgaaggttt tgctaaggct   300
ttggctgaag aaatcaaagc cagatacgaa aaagctgccg ttaaggttat tgatttggat   360
gattacacag ccgaagatga caaatacggt gaaaagttga gaaagaaac tatggccttc    420
ttcatgttgg ctacttatgg tgatggtgaa cctactgata atgctgctag attttacaag   480
tggttcaccg aaggtactga tagaggtgtt tggttggaac atttgagata cggtgtattc   540
ggtttgggta cagacaata cgaacacttc aacaagattg ccaaggttgt tgatgatttg    600
ttggttgaac aaggtgccaa gagattggtt actgttggtt gggtgatga tgatcaatgc    660
atcgaagatg atttctccgc ttggaaagaa gccttgtggc cagaattgga tcaattattg   720
caagatgata ccaacaccgt ttctactcca tacactgctg ttattccaga atacagagtt   780
gttatccacg atccatctgt tacctcttat gaagatccat actctaacat ggctaacggt   840
aatgcctctt acgatattca tcatccatgt agagctaacg ttgccgtcca aaaagaattg   900
cataagccag aatctgacag aagttgcatc catttggaat tcgatatttt cgctactggt   960
ttgacttacg aaaccggtga tcatgttggt gtttacgctg ataattgtga tgatactgta  1020
gaagaagccg ctaagttgtt gggtcaacca ttggatttgt tgttctccat tcataccgat  1080
aacaacgacg gtacttcttt gggttcttct ttgccaccac catttccagg tccatgtact  1140
ttgagaactg ctttggctag atatgccgat ttgttgaatc caccaaaaaa ggctgctttg  1200
attgctttag ctgctcatgc tgatgaacca tctgaagctg aaagattgaa gttcttgtca  1260
tctccacaag gtaaggacga atattctaaa tgggttgtcg gttcccaaag atccttggtt  1320
gaagttatgg ctgaatttcc atctgctaaa ccaccattgg gtgtatttt tgctgctgtt  1380
gttcctagat gcaacctag atattactcc atctcttcca gtccaagatt tgctccacat  1440
agagttcatg ttacttgcgc tttggtttat ggtccaactc caactggtag aattcacaga  1500
ggtgtatgtt cattctggat gaagaatgtt gtcccattgg aaaagtctca aaactgttct  1560
tgggccccaa ttttcatcag acaatctaat ttcaagttgc cagccgatca ttctgttcca  1620
atagttatgg ttggtccagg tactggtta gctccttttta gaggtttctt acaagaaaga  1680
ttggccttga agaagaagg tgctcaagtt ggtcctgctt tgttgttttt tggttgcaga  1740
aacagacaaa tggacttcat ctacgaagtc gaattgaaca actttgtcga acaaggtgct  1800
ttgtccgaat tgatcgttgc ttttttcaaga gaaggtccat ccaaagaata cgtccaacat  1860
aagatggttg aaaaggcagc ttacatgtgg aacttgattt ctcaaggtgg ttacttctac  1920
gtttgtggtg atgctaaagg tatggctaga gatgttcata gaacattgca taccatcgtc  1980
caacaagaag aaaaggttga ttctaccaag gccgaatcca tcgttaagaa attgcaaatg  2040
gacggtagat acttgagaga tgtttggtga                                   2070

SEQ ID NO: 291
MSSNSDLVRR LESVLGVSFG GSVTDSVVVI ATTSIALVIG VLVLLWRRSS DRSREVKQLA    60
VPKPVTIVEE EDEFEVASGK TRVSIFYGTQ TGTAEGFAKA LAEEIKARYE KAAVKVIDLD   120
DYTAEDDKYG EKLKKETMAF FMLATYGDGE PTDNAARFYK WFTEGTDRGV WLEHLRYGVF   180
GLGNRQYEHF NKIAKVVDDL LVEQGAKRLV TVGLGDDDQC IEDDFSAWKE ALWPELDQLL   240
QDDTNTVSTP YTAVIPEYRV VIHDPSVTSY EDPYSNMANG NASYDIHHPC RANVAVQKEL   300
HKPESDRSCI HLEFDIFATG LTYETGDHVG VYADNCDDTV EEAAKLLGQP LDLLFSIHTD   360
NNDGTSLGSS LPPPFPGPCT LRTALARYAD LLNPPKKAAL IALAAHADEP SEAERLKFLS   420
SPQGKDEYSK WVVGSQRSLV EVMAEFPSAK PPLGVFFAAV VPRLQPRYYS ISSSPRFAPH   480
RVHVTCALVY GPTPTGRIHR GVCSFWMKNV VPLEKSQNCS WAPIFIRQSN FKLPADHSVP   540
IVMVGPGTGL APFRGFLQER LALKEEGAQV GPALLFFGCR NRQMDFIYEV ELNNFVEQGA   600
LSELIVAFSR EGPSKEYVQH KMVEKAAYMW NLISQGGYFY VCGDAKGMAR DVHRTLHTIV   660
QQEEKVDSTK AESIVKKLQM DGRYLRDVW                                    689
```

TABLE 3-continued

Sequences disclosed herein.

SEQ ID NO: 292
```
atgacttctg cactttatgc ctccgatctt ttcaaacaat tgaaaagtat catgggaacg    60
gattctttgt ccgatgatgt tgtattagtt attgctacaa cttctctggc actggttgct   120
ggtttcgttg tcttattgtg gaaaaagacc acggcagatc gttccggcga gctaaagcca   180
ctaatgatcc ctaagtctct gatggcgaaa gatgaggatg atgacttaga tctaggttct   240
ggaaaaacga gagtctctat cttcttcggc acacaaaccg gaacagccga aggattcgct   300
aaagcacttt cagaagagat caaagcaaga tacgaaaagg cggctgtaaa agtaatcgat   360
ttggatgatt acgctgccga tgatgaccaa tatgaggaaa agttgaaaaa ggaaacattg   420
gctttctttt gtgtagccac gtatggtgat ggtgaaccaa ccgataacgc cgcaagattc   480
tacaagtggt ttactgaaga aacgaaaga gatatcaagt gcagcaact tgcttacggc    540
gttttttgcct taggtaacag acaatacgag cactttaaca agataggtat tgtcttagat   600
gaagagttat gcaaaaaggg tgcgaagaga ttgattgaag tcggttttagg agatgatgat   660
caatctatcg aggatgactt taatgcatgg aaggaatctt tgtggtctga attagataag   720
ttacttaagg acgaagatga taaatccgtt gccactccat acacagccgt cattccagaa   780
tatagagtag ttactcatga tccaagattc acaacacaga aatcaatgga aagtaatgtg   840
gctaatggta atactaccat cgatattcat catccatgta gagtagacgt tgcagttcaa   900
aaggaattgc acactcatga atcagacaga tcttgcatac atcttgaatt tgatatatca   960
cgtactggta tcacttacga aacaggtgat cacgtgggtg tctacgctga aaaccatgtt  1020
gaaattgtag aggaagctgg aaagttgttg ggccatagtt tagatcttgt tttctcaatt  1080
catgccgata aagaggatgg ctcaccacta gaaagtgcag tgcctccacc atttccagga  1140
ccatgcaccc taggtaccgg tttagctcgt tacgcggatc tgttaaatcc tccacgtaaa  1200
tcagctctag tggccttggc tgcgtacgcc acagaacctt ctgaggcaga aaaactgaaa  1260
catctaactt caccagatgg taaggatgaa tactcacaat ggatagtagc tagtcaacgt  1320
tctttactag aagttatggc tgcttttcca tccgctaaac ctcctttggg tgttttcttc  1380
gccgcaatag cgcctagact gcaaccaaga tactattcaa tttcatcctc acctagactg  1440
gcaccatcaa gagttcatgt cacatccgct ttagtgtaga gtccaactcc tactggtaga  1500
atccataagg gcgtttgttc aacatggatg aaaaacgcgg ttccagcaga gaagtctcac  1560
gaatgttctg tgctccaat ctttatcaga gcctccaact tcaaactgcc ttccaatcct   1620
tctactccta ttgtcatggt cggtcctggt acaggtcttg ctccattcag aggtttctta  1680
caagagagaa tggccttaaa ggaggatggt gaagagttgg gatcttcttt gttgttttc    1740
ggctgtagaa acagacaaat ggatttcatc tacgaagatg aactgaataa ctttgtagat  1800
caaggagtta tttcagagtt gataatggct ttttctagag aaggtgctca gaaggagtac  1860
gtccaacaca aaatgatgga aaaggccgca caagtttggg acttaatcaa agaggaaggc  1920
tatctatatg tctgtggtga tgcaaagggt atggcaagag atgttcacag aacacttcat  1980
actatagtcc aggaacagga aggcgttagt cttctgaag cggaagcaat tgtgaaaaag   2040
ttacaaacag agggaagata cttgagagat gtgtggtaa                          2079
```

SEQ ID NO: 293
```
MTSALYASDL FKQLKSIMGT DSLSDDVVLV IATTSLALVA GFVVLLWKKT TADRSGELKP    60
LMIPKSLMAK DEDDDLDLGS GKTRVSIFFG TQTGTAEGFA KALSEEIKAR YEKAAVKVID   120
LDDYAADDDQ YEEKLKKETL AFFCVATYGD GEPTDNAARF YKWFTEENER DIKLQQLAYG   180
VFALGNRQYE HFNKIGIVLD EELCKKGAKR LIEVGLGDDD QSIEDDFNAW KESLWSELDK   240
LLKDEDDKSV ATPYTAVIPE YRVVTHDPRF TTQKSMESNV ANGNTTIDIH HPCRVDVAVQ   300
KELHTHESDR SCIHLEFDIS RTGITYETGD HVGVYAENHV EIVEEAGKLL GHSLDLVFSI   360
HADKEDGSPL ESAVPPPFPG PCTLGTGLAR YADLLNPPRK SALVALAAYA TEPSEAEKLK   420
HLTSPDGKDE YSQWIVASQR SLLEVMAAFP SAKPPLGVFF AAIAPRLQPR YYSISSSPRL   480
APSRVHVTSA LVYGPTPTGR IHKGVCSTWM KNAVPAEKSH ECSGAPIFIR ASNFKLPSNP   540
STPIVMVGPG TGLAPFRGFL QERMALKEDG EELGSSLLFF GCRNRQMDFI YEDELNNFVD   600
QGVISELIMA FSREGAQKEY VQHKMMEKAA QVWDLIKEEG YLYVCGDAKG MARDVHRTLH   660
TIVQEQEGVS SSEAEAIVKK LQTEGRYLRD VW                                  692
```

SEQ ID NO: 294
```
atggaagtaa cagtagctag tagtgtagcc ctgagcctgg tctttattag catagtagta    60
agatgggcat ggagtgtggt gaattgggtg tggtttaagc cgaagaagct ggaaagattt   120
ttgagggagc aaggccttaa aggcaattcc tacaggtttt tatatggaga catgaaggag   180
aactctatcc tgctcaaaca agcaagatcc aaacccatga acctctccac ctccatgac    240
atagcacctc aagtcacccc ttttgtcgac caaaccgtga aagctacgg taagaactct   300
tttaattggg ttggccccat accaaggggt aacataatga atccagaaga tttgaaggac   360
gtcttaacaa aaaatgttga ctttgttaag ccaatatcaa acccacttat caagttgcta   420
gctacaggta ttgcaatcta tgaaggtgag aaatggacta acacagaag gattatcaac   480
ccaacattcc attcggagag gctaaagcgt atgttaccct catttcacca aagttgtaat   540
gagatggtca aggaatggga gagcttggtg tcaaagagg gttcatcatg tgagttggat   600
gtctggcctt tccttgaaaa atatgtcgca gatgtgatct cgagaacagc atttggaact   660
agctacaaaa aaggacagaa atctttgaa ctcttgagag agcaagtaat atatgtaacg    720
aaaggctttc aaagttttta cattccagga tggaggtttt cccaactaa gatgaacaag   780
aggatgaatg agattaacga agaaatagaa ggattaatca gggtattat aattgacaga   840
gagcaaatca ttaaggcagg tgaagaaacc aacgatgact tattaggtgc acttatggag   900
```

TABLE 3-continued

Sequences disclosed herein.

```
tcaaacttga aggacattcg ggaacatggg aaaaacaaca aaaatgttgg gatgagtatt    960
gaagatgtaa ttcaggagtg taagctgttt tactttgctg ggcaagaaac cacttcagtg   1020
ttgctggctt ggacaatggt tttacttggt caaaatcaga actggcaaga tcgagcaaga   1080
caagaggttt tgcaagtctt tggaagcagc aagccagatt ttgatggtct agctcacctt   1140
aaagtcgtaa ccatgatttt gcttgaagtt cttcgattat acccaccagt cattgaactt   1200
attcgaacca ttcacaagaa aacacaactt gggaagctct cactaccaga aggagttgaa   1260
gtccgcttac caacactgct cattcaccat gacaaggaac tgtggggtga tgatgcaaac   1320
cagttcaatc cagagaggtt ttcggaagga gtttccaaag caacaaagaa ccgactctca   1380
ttcttcccct tcggagccgg tccacgcatt tgcattggac agaacttttc tatgatggaa   1440
gcaaagttgg ccttagcatt gatcttgcaa cacttcacct ttgagctttc tccatctcat   1500
gcacatgctc cttcccatcg tataacccct caaccacagt atggtgttcg tatcatttta   1560
catcgacgtt ag                                                       1572

SEQ ID NO: 295
atggaagtca ctgtcgcctc ttctgtcgct ttatccttag tcttcatttc cattgtcgtc     60
agatgggctt ggtccgttgt caactgggtt tggttcaaac caaagaagtt ggaaagattc    120
ttgagagagc aaggtttgaa gggtaattct tatagattct tgtacggtga catgaaggaa    180
aattctattt tgttgaagca agccagatcc aaaccaatga acttgtctac ctctcatgat    240
attgctccac aagttactcc attcgtcgat caaactgtta aagcctacgg taagaactct    300
ttcaattggg ttggtccaat tcctagagtt aacatcatga acccagaaga tttgaaggat    360
gtcttgacca agaacgttga cttcgttaag ccaatttcca acccattgat taaattgttg    420
gctactggta ttgccattta cgaaggtgaa aagtggacta agcatagaag aatcatcaac    480
cctaccttcc actctgaaag attgaagaga atgttaccat ctttccatca atcctgtaat    540
gaaatggtta aggaatggga atccttggtt tctaaagaag gttcttcttg cgaattggat    600
gtttggccat tcttggaaaa tatgtctgct gatgtcattt ccagaaccgc tttcggtacc    660
tcctacaaga agggtcaaaa gattttcgaa ttgttgagag agcaagttat ttacgttacc    720
aaggggtttcc aatccttcta catcccaggt tggagattct tgccaactaa aatgaacaag    780
cgtatgaacg agatcaacga agaaattaaa gtttgatca gaggtattat tatcgacaga    840
gaacaaatta ttaaagctgg tgaagaaacc aacgatgatt tgttgggtgc tttgatggag    900
tccaacttga aggatattag agaacatggt aagaacaaca agaatgttgg tatgtctatt    960
gaagatgtta ttcaagaatg taagttattc tacttcgctg gtcaagagac cacttctgtt   1020
ttgttagcct ggactatggt cttgttaggt caaaaccaaa attggcaaga tagagctaga   1080
caagaagttt tgcaagtctt cggttcttcc aagccagact ttgatggttt ggcccacttg   1140
aaggttgtta ctatgatttt gttagaagtt ttgagattgt acccaccagt cattgagtta   1200
atcagaacca ttcataaaaa gactcaattg ggtaaattat ctttgccaga aggtgttgaa   1260
gtcagattac caaccttgtt gattcaccac gataaggaat tatggggtga cgacgctaat   1320
caatttaatc cagaaagatt ttccgaaggt gtttccaagg ctaccaaaaa ccgtttgtcc   1380
ttcttcccat ttggtgctgg tccacgtatt tgtatcggtc aaaacttttc catgatggaa   1440
gccaagttgg ctttggcttt aatcttgcaa cacttcactt tcgaattgtc tccatcccat   1500
gcccacgctc cttctcatag aatcacttta caaccacaat acggtgtcag aatcatctta   1560
cacagaagat aa                                                      1572
```

Having described the invention in detail and by reference to specific embodiments thereof, it will be apparent that modifications and variations are possible without departing from the scope of the invention defined in the appended claims. More specifically, although some aspects of the present invention are identified herein as particularly advantageous, it is contemplated that the present invention is not necessarily limited to these particular aspects of the invention.

SEQUENCE LISTING (295 sequences)

SEQ ID NO: 1 - DNA, 2028 bp, Saccharomyces cerevisiae
atggtatcagccaacggcgacttgcacttgccaatttctaacgaacagtgcatgccggaaaacaatggatctcttggatttgaggcccccactccgagacagattctcagggttacgttaaatttgaaatacttaattgataaggtcgtacctattgtttacgatcccaatgatattgtttgtgaccattctgagattttatctccaaaagttgtgaagctggcttatgaagcatgtggcgggaaccctaaagacaaggccaacaaaagaaaatatcaatctgtcattattttttcacttcttaaagtttgtgagtggtattccatattggccactatggaagtgcacaatgccaaactttacgaaaccagaaatttagcctcacaacagttatgtaaattgttaattgaaagggaggagacaagagacctgcagtttcttttcatgcagttactgctgcgtcggtacgtaatcaacgagaacgatgaagatcaagaaccgttgaatgccttggaacttgccacagatatgcactgtactacagtgataggatcgagtggatttcagcgttgtttaaaatggatatggagaggatggatagtccaaaatggcttggatcccacaacttttatcaaggacgattcactggcggaagtgtcattgatctctcatttcaaccccgtaagattaaaggcgcctgtataccaaaattatttgcagatgatcttctcatttttgtttctagggctttataccttggtggttaatggtaaggactctgagagagtccaatctttcgatttgttagaaagcatattttatgttttcaatactggtttcatcttggatgagctcactaagctttattatattggttatgcgcacctatcgttttggaatttatttaatgataccacatatttgataatcacgtttgctatggggttccgtgcaatgagcgtaacgccccttaatgcaaaatactcttcagaagattgggataaaatatcatatagagtcttatcctgtgcagcaccatttgtgtggtcgagactcctactataccttgaatcacaaaggtttattgggattatgttggttatcctaaaacatatgatgaaagaatccattgtatttttcttccttctattcttaataatgataggattcactcaaggtttcttaggtttggattccgcagatggtaagagagatatcaccggacccatcctgggtaatttaacaatcaccgttttgggtcttggtagttttgatgttttcgaagaattcgctcccccatatgcggcaatactgtattatggttactattttattgtttcggttatccttttgaatatattaattgctttgtattcgactgcgtaccaaaaagttattgacaatgcagatgacgagtacatggctttgatgtcacaaaagacgttgagatacattagagcacctgatgaagatgtctatgtttctccattgaacttaattgaagtgttcatgacacctatctttcgtattcttccaccgaagcgtgctaaagatttgagctatactgtaatgacaatagtgtacagcccatttttgttgcttatttctgttaaagaaactcgggaggctagaaggataaaatataacaggatgaaaaggttaaacgatgatgccaatgaatatgatactccatgggatttgacagatggctacttggatgatgatgacggtttgttttctgataaccgaaattctggcatgagagccacccagttaaagaattcccgttcgctaaaactgcaaagaacagcagagcaggaagatgtccattttaaagtccctaagaagtggtataaaaacgttaaaaaatgcagtccctccttcgaacagtatgataacgatgacactgaagatgatgctggtgaagataaagatgaagtcaaagagctcactaagaaagtggaaaacttgacagctgtaattaccgatctactcgaaaaattagacataaaggataagaaagagtaa

SEQ ID NO: 2 - protein, 675 aa, Saccharomyces cerevisiae
MVSANGDLHLPISNEQCMPENNGSLGFEAPTPRQILRVTLNLKYLIDKVVPIVYDPNDIVCDHSEILSPKVVKLAYEACGGNPKDKANKRKYQSVIIFSLLKVCEWYSILATMEVHNAKLYETRNLASQQLCKLLIEREETRDLQFLFMQLLLRRYVINENDEDQEPLNALELATDMHCTTVIGSSGFQRCLKWIWRGWIVQNGLDPTTFIKDDSLAEVSLISHFNPVRLKAPVYQNYLQMIFSFLFLGLYTLVVNGKDSERVQSFDLLESIFYVFNTGFILDELTKLYYIGYAHLSFWNLFNDTTYLIITFAMGFRAMSVTPLNAKYSSEDWDKISYRVLSCAAPFVWSRLLLYLESQRFIGIMLVILKHMMKESIVFFFLLFLIMIGFTQGFLGLDSADGKRDITGPILGNLTITVLGLGSFDVFEEFAPPYAAILYYGYYFIVSVILLNILIALYSTAYQKVIDNADDEYMALMSQKTLRYIRAPDEDVYVSPLNLIEVFMTPIFRILPPKRAKDLSYTVMTIVYSPFLLLISVKETREARRIKYNRMKRLNDDANEYDTPWDLTDGYLDDDDGLFSDNRNSGMRATQLKNSRSLKLQRTAEQEDVHFKVPKKWYKNVKKCSPSFEQYDNDDTEDDAGEDKDEVKELTKKVENLTAVITDLLEKLDIKDKKE

SEQ ID NO: 3 - DNA, 1329 bp, Saccharomyces cerevisiae
atgaataggactgtctttttggcatttgtatttggatggtatttctgttcaatagctctctccatatacaatagatggatgttcgatccgaaggacggattgggtattgggtatcccgtgttggtgacaacattccatcaggctactttatggttactatccggcatatacattaagctcaggcataagccagtgaaaaacgttttaagaaagaataatggttttaactggagtttttttctaaaatttttactccctacggcagtcgcttctgcaggtgatatcgggctcagtaacgtttccttccagtatgttcccttgacaatttatacaattatcaaatcttcgagcatagcttttgtccttttattcggctgtatcttcaagctagaaaagtttcattggaagttggcactttcagtaataattatgtttgttggtgtagcattaatggttttcaaaccaagcgattccaccagtaccaaaaacgaccaagccttggtcatttttggcagctttcttgtcctagcaagtagctgtctttctgggttaaggtgggtttatacgcagttgatgcttaggaacaacccaattcaaactaacaccgctgcagcagtagaggaatctgatggtgcccttttcacggaaaatgaagataatgtcgataatgaacctgttgttaacctcgccaataacaaaatgctggagaattttggagaatccaagcctcacccaattcatacaatccaccagttagctcctataatgggcattactctgttgcttacctcgctacttgtggaaaaaccatttcctggtatattcagctctagcatatttaggcttgatacgagcaatggcggtgtcggcacggaaactaccgtcctatccattgtgaggggtattgttttgttaattttacctggttttgcagtctttttgttgacaatttgtgagtttagtattttggagcaaacgcccgtgctgaccgtatctattgtgggtatagtgaaggaacttttgacggtaatatttggtataattattctttctgaaagattaagtggtttttacaattggttaggaatgcttattattatggcagatgtatgctattataattacttcagatataagcaagatctattacaaaaatatcattcagtttcgacacaagataatcgtaacgagttaaagggatttcaagacttcgaacagttaggaagcaagaaaatcgcaccatattctattagtgtcgacctaacaaatcaagagtatgagcttgatatgattgctcaaaacgttagtcgttcatcccagcaggtctga

SEQ ID NO: 4 - protein, 442 aa, Saccharomyces cerevisiae
MNRTVFLAFVFGWYFCSIALSIYNRWMFDPKDGLGIGYPVLVTTFHQATLWLLSGIYIKLRHKPVKNVLRKNNGFNWSFFLKFLLPTAVASAGDIGLSNVSFQYVPLTIYTIIKSSSIAFVLLFGCIFKLEKFHWKLALSVIIMFVGVALMVFKPSDSTSTKNDQALVIFGSFLVLASSCLSGLRWVYTQLMLRNNPIQTNTAAAVEESDGALFTENEDNVDNEPVVNLANNKMLENFGESKPHPIHTIHQLAPIMGITLLLTSLLVEKPFPGIFSSSIFRLDTSNGGVGTETTVLSIVRGIVLLILPGFAVFLLTICEFSILEQTPVLTVSIVGIVKELLTVIFGIIILSERLSGFYNWLGMLIIMADVCYYNYFRYKQDLLQKYHSVSTQDNRNELKGFQDFEQLGSKKIAPYSISVDLTNQEYELDMIAQNVSRSSQQV

SEQ ID NO: 5 - DNA, 264 bp, Saccharomyces cerevisiae
atgtcttctctatcaacgtctgatttggcctcccttgatgacacttccaaaaaggaaattgctactttcttggagggagagaactccaaacaaaaagtccagatgtcaatccatcaattcactaatatatgcttcaaaaaatgtgttgagtctgtcaatgattctaatttaagttcgcaagaagagcaatgtttgtctaactgtgtgaatcggtttttggatactaatatcaggattgtgaacgggttgcaaaacacccgttaa

SEQ ID NO: 6 - protein, 87 aa, Saccharomyces cerevisiae
MSSLSTSDLASLDDTSKKEIATFLEGENSKQKVQMSIHQFTNICFKKCVESVNDSNLSSQEEQCLSNCVNRFLDTNIRIVNGLQNTR

SEQ ID NO: 7 - DNA, 4590 bp, Saccharomyces cerevisiae
atgtcatcagatatcagagacgtagaggaacgaaattcgcggagctcgagctcaagctcgagctcgaactctgccgcccaatccattggacagcatccataccgcggtttcgacagcgaagccgcggaaagggtgcatgagttggctagaacactcacatcgcagagtttactatacactgctaactcaaacaatagctcttccagcaaccataatgcgcacaatgcggactcgagatccgtattttctacggacatggaaggtgtgaacccggtgttcactaacccggacaccccgggatacaatcccaaattggaccctaacagtgatcaattctccagtacggcgtgggtacagaacatggcaaatatttgtacttcggacccggatttctataaaccatactcactcggttgtgtatggaagaatctaagcgcctccggagactccgccgatgtgtcataccagtcaactttcgctaacatcgtaccaaagctgcttacgaaagggctcagattactgaagcccagtaaagaagaggacacttttcagatcctgaaacccatggatggttgtcttaatcccggtgaactgttggttgttcttgggagaccagggtcaggttgtactacgctgctaaaatccatatcttctaattcgcacgggttcaagatcgcaaaagactccattgtctcttacaacggtttgtcaagctcggatatcaggaaacattaccgtggtgaagtcgtttacaatgcggaatcagatattcatttaccgcatcttaccgtgtaccagacgcttttcaccgtggcaaggatgaaaacgccgcaaaatcgtatcaagggtgttgatagagaagcgtacgccaatcacgtgacagaagttgcaatggccacatatggtctttcgcatacaagggacaccaaggtcggaaacgatctagtcagaggtgtttctggtggtgaaagaaagcgtgtatccattgcggaagtcgcaatctgcggcgccagatttcaatgttgggataatgccaccagaggtttggactctgctactgctttagaattcatccgtgctttaaaaacccaggctgacattggaaagaccgcggctactgtggccatctatcaatgttctcaggatgcttatgatctttttgataaggtctgtgtcctggatgatggttaccagctttattttgggcccgctaaggatgcaaagaaatatttccaagacatgggctactattgtcctcccagacagaccactgcagattttttaacttcaattacaagtcctactgaaagaattattagcaaagaatttatcgaaaaaggtactagagtgcctcaaacgccaaaggatatggccgaatattggctacaatcagaaagctacaaaaatttaatcaaggatatagactctacattagagaaaaacacagatgaagcacgcaatattatcagggatgctcaccacgctaaacaggcaaaaagggcaccaccttcctctccatacgttgtcaactacggaatgcaagtcaaatacttgttgattagaaatttctggagaatgaagcaaagtgctagtgttactttgtggcaagtcatcggtaactctgtcatggctttcatcttgggttctatgttttataaagtgatgaagaaaaacgatacttccactttctatttccgtggtgctgcaatgttttttgctattttatttaatgcattttcgtgtcttttggaaatctttagtttgtatgaaacaagacctataactgaaaaacacagaacttattccttgtatcatccaagcgctgacgcatttgcgtctgttttgtcagaaatgccgccaaaattgatcactgctgtctgcttcaacatcatcttttatttcctagttgatttcaggagaaacggtggtgtctttttcttttattttttaattaatgtcattgccacattcactttatcccatttatttagatgcgtgggctccttgaccaaaacattacaggaggccatggtccccgcttcaatgttattattggcaatttctatgtatacagggtttgccatccctaaaacgaagattttaggttggtccatttggatttggtatatcaacccgctagcctacctgtttgaatctttaatgatcaatgaattccatgaccgtagattcccttgtgcccaatacatccctgctggccctgcttatcagaacatcacaggtactcaacgcgtctgttccgcagttggtgcttatccaggtaacgactatgtgttgggtgatgacttcttgaaggaaagttacgattatgagcacaaacataagtggcgtgggttcggtattggtatggcatatgttgttttctttttctttgtttatctaattctttgtgagtataatgaaggtgctaaacaaaagggtgaaatggttgtgttcctaagatctaagatcaagcaattgaaaaaggaaggtaaattacaagaaaagcataggcctggagatattgaaaataatgcaggcagttctccagattccgctacaacagaaaaaaaaatactagatgatagttctgagggatcggatagctcttcagataatgccggattaggactttccaaatctgaagcaattttccactggcgtgatttatgctatgatgttcctataaaaggaggtcaaagacgtatcttaaataacgtagatggttgggtaaaaccaggcactttgactgccttaatgggggcgtcaggtgcaggtaaaacaactttactggattgtttggctgaaagagtcaccatgggtgttattactggtaatatttttgtcgatggtcgtctccgtgacgaatcattccctagatctattggttattgtcaacaacaggatttacatttgaaaacggctacagtaagagaatctttgagattttcagcttatttacgtcagccttcgtcagtttctattgaagaaaaaaataggtacgtggaagaagttatcaaaattttggaaatgcaacaatattcagatgctgttgttggtgttgcaggtgaaggtctaaatgtcgaacaaagaaaaagacttactattggtgttgaactagcggcaaggcctaaacttttggtttttttggatgaaccaacttcaggcctggattcacaaactgcttgggacacttgccaacttatgaggaaactagctacccacggtcaagcaattttgtgtactatccatcaaccttctgctatattaatgcagcagtttgatagattattatttttacagaaagggggccaaactgtatatttcggcgatttaggtgaagggtgcaaaactatgatcgattattttgaaagtaaaggagctcacaaatgtccacctgatgcaaaccctgccgaatggatgttagaggttgtaggtgccgctcctggttctcacgctacgcaagattataatgaagtctggagaaactcagatgaatacaaagctgttcaggaagaattggattggatggaaaagaatttaccaggcaggtcaaaagaaccaactgcagaagaacataaaccttttgctgcatctttatactaccaatttaaaatggttaccattcgtttgttccaacaatactggagatcaccagattatttatggtcgaaatttattttgactattttcaaccaagtttttattgggttcacttttttcaaggctgacagaagtttacagggactacaaaaccaaatgttatcaatattcatgtatacggttattttcaatcctatactacaacagtatctaccatctttcgtgcagcaaagggatttgtatgaggcaagagaacgtccttcaagaacattttcgtggcttgcgtttttcctctctcaaatcattgttgaaatcccatggaatattttagcgggtacgattgcttattgtatttactattacgcggttggattttatgcgaacgcctcagctgctggtcaactccatgagagaggtgctttgttttggttattttctattgccttctacgtctacattggttcgatgggtttgttaatgatttctttcaatgaagttgctgaaacagcggcacatatgggaacgctattgttcacgatggcattatctttctgtggtgttatggctacccctaaggttatgccaagattttggatctttatgtatagagtgtcacccctaacttatatgatcgatgcattattagcccttggtgtggctaatgtggacgttaagtgttcaaattatgaaatggtaaaatttactccaccatctggaaccacctgcggtgactatatggcatcatatatcaagttggccggaacaggctacttgagtgacccgtctgcaacagatatatgtagtttctgtgcggtatccaccaccaatgcctttttggccactttcagttctcattattacagaagatggagaaattacggtatttttatctgctatattgcttttgattatatcgctgcaacattcttgtattggttatccagggtacccaagaagaacggtaagatttccgaaaaacccaagaagtga

SEQ ID NO: 8 - protein, 1529 aa, Saccharomyces cerevisiae
MSSDIRDVEERNSRSSSSSSSSNSAAQSIGQHPYRGFDSEAAERVHELARTLTSQSLLYTANSNNSSSSNHNAHNADSRSVFSTDMEGVNPVFTNPDTPGYNPKLDPNSDQFSSTAWVQNMANICTSDPDFYKPYSLGCVWKNLSASGDSADVSYQSTFANIVPKLLTKGLRLLKPSKEEDTFQILKPMDGCLNPGELLVVLGRPGSGCTTLLKSISSNSHGFKIAKDSIVSYNGLSSSDIRKHYRGEVVYNAESDIHLPHLTVYQTLFTVARMKTPQNRIKGVDREAYANHVTEVAMATYGLSHTRDTKVGNDLVRGVSGGERKRVSIAEVAICGARFQCWDNATRGLDSATALEFIRALKTQADIGKTAATVAIYQCSQDAYDLFDKVCVLDDGYQLYFGPAKDAKKYFQDMGYYCPPRQTTADFLTSITSPTERIISKEFIEKGTRVPQTPKDMAEYWLQSESYKNLIKDIDSTLEKNTDEARNIIRDAHHAKQAKRAPPSSPYVVNYGMQVKYLLIRNFWRMKQSASVTLWQVIGNSVMAFILGSMFYKVMKKNDTSTFYFRGAAMFFAILFNAFSCLLEIFSLYETRPITEKHRTYSLYHPSADAFASVLSEMPPKLITAVCFNIIFYFLVDFRRNGGVFFFYFLINVIATFTLSHLFRCVGSLTKTLQEAMVPASMLLLAISMYTGFAIPKTKILGWSIWIWYINPLAYLFESLMINEFHDRRFPCAQYIPAGPAYQNITGTQRVCSAVGAYPGNDYVLGDDFLKESYDYEHKHKWRGFGIGMAYVVFFFFVYLILCEYNEGAKQKGEMVVFLRSKIKQLKKEGKLQEKHRPGDIENNAGSSPDSATTEKKILDDSSEGSDSSSDNAGLGLSKSEAIFHWRDLCYDVPIKGGQRRILNNVDGWVKPGTLTALMGASGAGKTTLLDCLAERVTMGVITGNIFVDGRLRDESFPRSIGYCQQQDLHLKTATVRESLRFSAYLRQPSSVSIEEKNRYVEEVIKILEMQQYSDAVVGVAGEGLNVEQRKRLTIGVELAARPKLLVFLDEPTSGLDSQTAWDTCQLMRKLATHGQAILCTIHQPSAILMQQFDRLLFLQKGGQTVYFGDLGEGCKTMIDYFESKGAHKCPPDANPAEWMLEVVGAAPGSHATQDYNEVWRNSDEYKAVQEELDWMEKNLPGRSKEPTAEEHKPFAASLYYQFKMVTIRLFQQYWRSPDYLWSKFILTIFNQVFIGFTFFKADRSLQGLQNQMLSIFMYTVIFNPILQQYLPSFVQQRDLYEARERPSRTFSWLAFFLSQIIVEIPWNILAGTIAYCIYYYAVGFYANASAAGQLHERGALFWLFSIAFYVYIGSMGLLMISFNEVAETAAHMGTLLFTMALSFCGVMATPKVMPRFWIFMYRVSPLTYMIDALLALGVANVDVKCSNYEMVKFTPPSGTTCGDYMASYIKLAGTGYLSDPSATDICSFCAVSTTNAFLATFSSHYYRRWRNYGIFICYIAFDYIAATFLYWLSRVPKKNGKISEKPKK

SEQ ID NO: 9 - DNA, 1908 bp, Saccharomyces cerevisiae
atggctaacgacgctctaagtgctattttcagtaatccttcgaggaaaggtgtccaaccctccacatctattgtgtcatatacaaacaatgaagatgatattatagatgtggaaaatgggaagttcaacaagaacaagaatatcaacactaatgtgtatgtggacaactcctcaatagaggagagcgaagtcgtgcccttgcccgaaacaaagtccatctggagtaaaatatactacgatttcattgtgttagacaagacaactttgaatgtttcgttgaaagagtcgttcttgtataacagagacttgaaaccggttgaagaagaaagaaggtgttggtcctggttcaattacttatatttctggctggcagactgtttcaatattaacacatggcaaatagctggtacaggtctacaactaggtctgaattggtggcaatgttggcttacagtttggatcggctacacttttgcaggtatcttcgtagtattgaactcgagatttggttccgcatatcacttatctttccctattactgttagggcctcatttggtatattcttttctatgtggccgattataaatcgtgtcgtgatggctatagtatggtatgccgtgcaagcctggttaggtgcaacgcccgtggcactgatgctaaaatctatttttggcaagaatctggaagatagaatcccaaaccattttggttctccaaatagcactacttttgaattcatgtgtttctttatattttgggtggtcagtataccatttgtcctagtggctcctcataaaatcaggcatttattcacagtaaaagcagctttgatccccttcgcagcctttggatttttaatctgggctttgaagaaatcgcacggtaaaattgagttggggacgctgaatgattattcacctcatggttccgaattttcatggatattcgttagatccctaatggcctgtgttgctaactttgccgctttgattatcaacgcccctgacttcggtagatttgccaaaaatcctcaagcgtctttgtggccacaattggttgccatcccattgttcttcgccataacatgtttgatcggtatcattgttactgcggccggttatcacttatatggggttaactattggtcaccactggatgtacttggtcaatttttggagaccacttacaccagaggtactagggctggtgtgttcttgatttcttttgtatttgccttagctcaactgggtacaaacatttctgccaactctctggcatgtggtgctgatatgacggctttgtttccaagatatattaatattagaagaggttctttattctgtgtggcaatggctctatgtatctgtccatggaacttaatggccagttcaagtaagttcaccagcgctttgggtgcttatgcaattttcctttccagtattgctggtgtcatttgcgcggattatttcgtagtaagaagaggatatgtgaaattaacacatttattcctggcacagaagggttccttttacatgtttggaaacaaatttggtgccaattggagggcctttgttgcgtatatttgcggtatcgctccaaatttaccaggttttataggtgatgttggagctccaaaaattacggtttcagagggtgcaatgaggttatactatttaggttatccggtaggtttctttattagtgcggtgatatacctcatattatgttacttttttcctgtccctggtactcccgtaaccaattttctgacagagaaaggatggttccaaagatgggcttatgttgaggacttcgagcaagattggaagaatgagttacgtagggatgacctctgcgatgacacagtcagtatctatgatggcaccgaggaaaagatagtttactaa

SEQ ID NO: 10 - protein, 635 aa, Saccharomyces cerevisiae
MANDALSAIFSNPSRKGVQPSTSIVSYTNNEDDIIDVENGKFNKNKNINTNVYVDNSSIEESEVVPLPETKSIWSKIYYDFIVLDKTTLNVSLKESFLYNRDLKPVEEERRCWSWFNYLYFWLADCFNINTWQIAGTGLQLGLNWWQCWLTVWIGYTFAGIFVVLNSRFGSAYHLSFPITVRASFGIFFSMWPIINRVVMAIVWYAVQAWLGATPVALMLKSIFGKNLEDRIPNHFGSPNSTTFEFMCFFIFWVVSIPFVLVAPHKIRHLFTVKAALIPFAAFGFLIWALKKSHGKIELGTLNDYSPHGSEFSWIFVRSLMACVANFAALIINAPDFGRFAKNPQASLWPQLVAIPLFFAITCLIGIIVTAAGYHLYGVNYWSPLDVLGQFLETTYTRGTRAGVFLISFVFALAQLGTNISANSLACGADMTALFPRYINIRRGSLFCVAMALCICPWNLMASSSKFTSALGAYAIFLSSIAGVICADYFVVRRGYVKLTHLFLAQKGSFYMFGNKFGANWRAFVAYICGIAPNLPGFIGDVGAPKITVSEGAMRLYYLGYPVGFFISAVIYLILCYFFPVPGTPVTNFLTEKGWFQRWAYVEDFEQDWKNELRRDDLCDDTVSIYDGTEEKIVY

SEQ ID NO: 11 - DNA, 1845 bp, Saccharomyces cerevisiae
atgagtgatcaagaatctgttgtttcattcaactcacaaaacacttccatggtggacgttgagggccaacaacctcaacagtatgtcccctcaaaaaccaactctcgtgcaaatcaacttaagttaactaagactgagaccgtcaagtctttacaagatttaggtgtcacttcagccgccccagtgcctgatatcaatgcgccacaaactgctaagaataacattttccctgaagaatataccatggaaacaccatctgggctggttccagtggctaccttacaatctatgggtagaaccgcctctgccttatctcgtactagaacaaagcaattgaaccgtaccgctaccaattcctcatccacaggtaaagaagaaatggaagaggaagaaactgaagaacgtgaagaccagagcggtgaaaacgagctagatccagagatcgaattcgttacttttgttactggtgatccagaaaaccctcacaattggccctcatgggttcgttggagttacactgtcctgttgtccatcttagttatttgcgttgcctacggttctgcttgtatcagtggtgggttgggaaccgttgaaaagaaataccatgtaggtatggaagccgctattttatcatgttctttaatggttattgggttctcgctgggtcctttgatttggtctcctgttagtgatctttacggtagaagagttgcttactttgtttctatgggtctttatgtcatcttcaatatcccttgcgccttagctccaaatctaggttgtcttttagcttgtagatttttatgtggtgtttggtcatcatctggtttgtgtttagttggtgggtctattgccgatatgttcccaagtgaaacaagaggtaaggctattgctttcttcgcttttgctccttacgttggtcccgttgttggtccactagttaacggttttatttccgtttctaccggacgtatggacctgattttctgggtcaatatggcctttgcaggtgttatgtggatcatatcttctgccatcccagaaacgtacgctccagttatcttgaagagaaaggctgctagattaagaaaggaaactggtaatcccaagattatgactgagcaggaagcgcaaggtgtcagtatgagtgaaatgatgagggcttgtctgttgagacctttgtacttcgctgtcactgaacctgttctagttgccacttgtttctacgtgtgtttgatttactctctactatatgcgttcttctttgccttccctgtcattttcggtgaactatatggctacaaagataaccttgtgggtttaatgtttattcctattgttatcggtgctctttgggcgttagccacaactttctactgtgaaaacaaatatttacaaattgtcaaacagcgtaaacctactcctgaagatcgtttgctaggtgctaagatcggtgctccatttgctgcaattgctctatggatcctgggtgctaccgcttataaacatattatttgggttggtccagcttcagctggtttagcttttggtttcggtatggtgttgatttattattcattgaataattacattattgattgctacgtccaatacgcatccagtgctctggctacaaaggttttcttaagatccgccggtggtgctgccttccccttgtttaccattcaaatgtaccacaaattgaatttgcactggggttcttggttgttggctttcatctccactgctatgattgctttaccttttgcattttcttactggggtaagggcttgagacataagttgtccaagaaggactattccatcgacagtgttgagatgtaa

SEQ ID NO: 12 - protein, 622 aa, Saccharomyces cerevisiae
MNRQESINSFNSDETSSLSDVESQQPQQYIPSESGSKSNMAPNQLKLTRTETVKSLQDMGVSSKAPVPDVNAPQSSKNKIFPEEYTLETPTGLVPVATLHSIGRTSTAISRTRTRQIDGASSPSSNEDALESDNNEKGKEGDSSGANDEAPDLDPEIEFVTFVTGDPENPHNWPAWIRWSYTVLLSILVICVAYGSACISGGLGTVEKKYHVGMEAAILSVSLMVIGFSLGPLIWSPVSDLYGRRVAYFVSMGLYVIFNIPCALAPNLGSLLACRFLCGVWSSSGLCLVGGSIADMFPSETRGKAIAFFAFAPYVGPVVGPLVNGFISVSTGRMDLIFWVNMAFAGVMWIISSAIPETYAPVILKRKAARLRKETGNPKIMTEQEAQGVSMGEMMRACLLRPLYFSVTEPVLVATCFYVCLIYSLLYAFFFAFPVIFGELYGYKDNLVGLMFIPIVIGALWALATTFYCENKYLQIVKQRKPTPEDRLLGAKIGAPFAAIALWILGATAYKHIIWVGPASAGLAFGFGMVLIYYSLNNYIIDCYVQYASSALATKVFLRSAGGAAFPLFTIQMYHKLNLHWGSWLLAFISTAMIALPFAFSYWGKGLRHKLSKKDYSIDSIE

SEQ ID NO: 13 - DNA, 1710 bp, Saccharomyces cerevisiae
atgactgatcgtaaaaccaacttgccagaagaaccgattttcgaagaggcagaagatgatggctgcccttcgatagaaaattcttcacatctgtcagtacctacagtggaggaaaacaaggacttttccgagtataatggggaagaggcagaggaagttgttgttccagaaaagcctgcttcagcctatgctactgtttctatcatgtgtttatgtatggctttcggtggatttatgtccggttgggacacaggtacgatttctggtttcgtcaatcagactgattttttaagaagatttggtaattatagccattccaagaacacttactacttatctaatgtgagaactgggttgattgtgtccatcttcaatgtgggaagcgccattggctgtcttttcttgtctaaattgggtgatatttacggccgctgcatgggtttgattatagttattgtcgtttatatggttggtattgtcattcaaattgcctctatagataagtggtatcagtattttattggaagaattatcgctggtataggtgctggttccattagtgttcttgccccgatgcttatttcggaaactgcgccaaagcatatcagaggtacgttgctagcttgttggcaattgatggtgactttcgcaattttcttgggttattgtaccaattatggtaccaagacttactcgaattctgtccagtggcgtgttccgcttggtctatgttttgcatgggctattattatgattggtggtatgacgtttgttccggaatctcctcggtttttggtgcaagtcggtaagattgagcaagctaaagcttcttttgccaagtcgaacaagcttagtgttgacgatcctgctgtggttgcagagattgatcttcttgttgctggtgtggaggcagaagaagcaatgggaactgcttcatggaaggaattattttcgagaaagactaaagtttttcaacgtttaacgatgacagtcatgattaactctctgcagcaactaaccggtgacaactatttcttctactacggtactactatcttcaaatctgtcggtatgaatgactcttttgagacttcaattgtcttgggtattgtgaattttgcttcttgcttcttttcactttattctgttgataagttgggccgtcgtagatgtcttttacttggagcagccaccatgacggcgtgcatggttatttacgcctccgttggcgtcacaagactatatccgaacggtaaaagtgaaccatcatctaaaggtgctggtaattgtacgattgttttcacgtgtttttacattttctgcttttcctgcacctggggacctgtatgttatgtgattatttctgaaacatttccattaagggtgagatccaagtgtatgtccgttgcaacagcggccaacttattgtgggggttcctaatcgggtttttcactccttttattacttcggcaattaatttctactacggttacgttttcatgggttgcttagcgttttcatatttttacgtctttttctttgttccagaaacaaaaggtctaactttagaagaagttgatgagatgtggatggacggtgtattaccttggaaatctgaatcctgggtaccagcttctagaagggatggtgattatgataacgaaaaattacagcatgacgagaaacccttctacaaaagaatgttttag

SEQ ID NO: 14 - protein, 569 aa, Saccharomyces cerevisiae
MTDRKTNLPEEPIFEEAEDDGCPSIENSSHLSVPTVEENKDFSEYNGEEAEEVVVPEKPASAYATVSIMCLCMAFGGFMSGWDTGTISGFVNQTDFLRRFGNYSHSKNTYYLSNVRTGLIVSIFNVGSAIGCLFLSKLGDIYGRCMGLIIVIVVYMVGIVIQIASIDKWYQYFIGRIIAGIGAGSISVLAPMLISETAPKHIRGTLLACWQLMVTFAIFLGYCTNYGTKTYSNSVQWRVPLGLCFAWAIIMIGGMTFVPESPRFLVQVGKIEQAKASFAKSNKLSVDDPAVVAEIDLLVAGVEAEEAMGTASWKELFSRKTKVFQRLTMTVMINSLQQLTGDNYFFYYGTTIFKSVGMNDSFETSIVLGIVNFASCFFSLYSVDKLGRRRCLLLGAATMTACMVIYASVGVTRLYPNGKSEPSSKGAGNCTIVFTCFYIFCFSCTWGPVCYVIISETFPLRVRSKCMSVATAANLLWGFLIGFFTPFITSAINFYYGYVFMGCLAFSYFYVFFFVPETKGLTLEEVDEMWMDGVLPWKSESWVPASRRDGDYDNEKLQHDEKPFYKRMF

SEQ ID NO: 15 - DNA, 1704 bp, Saccharomyces cerevisiae
atgaattcaactccagatttaatatctccacaaaagtcaagtgagaattcgaatgctgacctgccttcgaatagctctcaggtaatgaacatgcctgaagaaaaaggtgttcaagatgatttccaagctgaggccgaccaagtacttaccaacccaaatacaggtaaaggtgcatatgtcactgtgtctatctgttgtgttatggttgccttcggtggtttcgttttcggttgggatactggtaccatttctggtttcgtcgcccaaactgatttcttgagaagattcggtatgaagcataaagatggtagttattatttgtctaaggttagaactggtttaattgtctccattttcaacattggttgtgccattggtggtattattttggctaaattgggtgatatgtacggtcgtaaaatgggtttgattgtcgttgttgttatctacatcatcggtattattattcaaattgcatccatcaacaaatggtaccaatatttcatcggtagaattatttccggtttgggtgttggtggtattgccgttttatctcctatgttgatttctgaagtcgctcctaaggaaatgagaggtactttagtctcctgttaccaactgatgattaccttgggtattttcttgggttactgtaccaacttcggtactaagaactactccaactctgtgcaatggagagttccattaggtttgtgttttgcctgggctttgtttatgatcggtggtatgactttcgttccagaatccccacgttatttggttgaagctggtcaaattgacgaagcaagagcatctctttccaaagttaacaaggttgccccagaccatccattcattcaacaagagttggaagttattgaagctagtgttgaagaagctagagctgctggttcagcatcatggggtgagttgttcactggtaagccggccatgtttaagcgtactatgatgggtatcatgatccaatctctacaacaattgactggtgataactatttcttctactatggtactaccgtttttaacgctgttggtatgagtgattctttcgaaacttctattgttttcggtgtcgtcaacttcttctctacttgttgttctttgtacactgtcgatcgttttggacgtcgtaactgtttgttatatggtgccattggtatggtctgctgttatgtagtttacgcttctgttggtgtcaccagactatggccaaatggtgaaggtaatggttcatccaagggtgctggtaactgtatgattgtctttgcctgtttctatattttctgttttgctaccacttgggctccaattgcttatgttgttatttctgaaactttcccattgagagtcaagtctaaggctatgtctattgctacagctgctaattggttgtggggtttcttgattggtttcttcactccatttattactggtgctattaacttctactacggttacgttttcatgggctgtatggttttcgcctacttctacgttttcttctttgtgccagaaactaagggtttgactttggaagaagtcaatgatatgtacgctgaaggtgttctaccatggaagtctgcttcatgggttccaacatctcaaagaggtgctaactacgatgctgatgcattgatgcatgatgaccagccattctacaagaaaatgttcggcaagaaataa

SEQ ID NO: 16 - protein, 567 aa, Saccharomyces cerevisiae
MNSTPDLISPQKSSENSNADLPSNSSQVMNMPEEKGVQDDFQAEADQVLTNPNTGKGAYVTVSICCVMVAFGGFVFGWDTGTISGFVAQTDFLRRFGMKHKDGSYYLSKVRTGLIVSIFNIGCAIGGIILAKLGDMYGRKMGLIVVVVIYIIGIIIQIASINKWYQYFIGRIISGLGVGGIAVLSPMLISEVAPKEMRGTLVSCYQLMITLGIFLGYCTNFGTKNYSNSVQWRVPLGLCFAWALFMIGGMTFVPESPRYLVEAGQIDEARASLSKVNKVAPDHPFIQQELEVIEASVEEARAAGSASWGELFTGKPAMFKRTMMGIMIQSLQQLTGDNYFFYYGTTVFNAVGMSDSFETSIVFGVVNFFSTCCSLYTVDRFGRRNCLLYGAIGMVCCYVVYASVGVTRLWPNGEGNGSSKGAGNCMIVFACFYIFCFATTWAPIAYVVISETFPLRVKSKAMSIATAANWLWGFLIGFFTPFITGAINFYYGYVFMGCMVFAYFYVFFFVPETKGLTLEEVNDMYAEGVLPWKSASWVPTSQRGANYDADALMHDDQPFYKKMFGKK

SEQ ID NO: 17 - DNA, 1179 bp, Escherichia coli
atgatttggattatgactatggcccgtagaatgaacggcgtctacgctgcttttatgttggttgctttcatgatgggtgttgccggtgctttgcaagctccaactttgtctttatttttgtccagagaagtcggtgctcaaccattctggatcggcttgttctacaccgtcaacgctattgctggtattggcgtttctttgtggttagctaagaggtctgactctcagggtgataggagaaagctgattatcttctgttgcttgatggctattggcaacgctctattgttcgccttcaacagacattacctgactctgatcacttgtggcgtcttgttggcttctttggctaatactgctatgccacaactattcgctttggctcgtgaatacgctgacaattctgctcgcgaagtggttatgttctcatctgttatgagggctcaattgtctttggcatgggttattggtccaccattggcattcatgctggctttgaactacggcttcaccgttatgttttccattgctgcaggcatcttcaccttgtctctagttctgatcgcctttatgttaccctccgtcgctagagttgaattgccatctgaaaatgctttgtctatgcaaggtggttggcaagactccaacgtcagaatgttgttcgttgcttctaccttgatgtggacctgcaacaccatgtacatcatcgatatgcccttgtggatttcctctgaattgggtttgccagacaagttagctggttttttgatgggtactgctgctggtttggagattccagctatgatcttggccggttactacgttaaacgctatggtaagaggagaatgatggttatcgctgttgctgccggcgttttgttttacactggcctgatcttgttccattctaggctggctctgatgactttgcaattgtttaatgctgtcttcatcggtatcgtcgccggtataggcatgttgtggtttcaggatttgatgccaggtagagctggtgctgctaccactttgtttaccaattctatttctactggcgtcattttggctggtgtcattcaaggtgccatcgctcaatcctggggtcacttcgctgtttattgggtcattgctgttatttccgttattgccttgttcctgactgctaaagtcaaggatgtttaa

SEQ ID NO: 18 - protein, 392 aa, Escherichia coli
MIWIMTMARRMNGVYAAFMLVAFMMGVAGALQAPTLSLFLSREVGAQPFWIGLFYTVNAIAGIGVSLWLAKRSDSQGDRRKLIIFCCLMAIGNALLFAFNRHYLTLITCGVLLASLANTAMPQLFALAREYADNSAREVVMFSSVMRAQLSLAWVIGPPLAFMLALNYGFTVMFSIAAGIFTLSLVLIAFMLPSVARVELPSENALSMQGGWQDSNVRMLFVASTLMWTCNTMYIIDMPLWISSELGLPDKLAGFLMGTAAGLEIPAMILAGYYVKRYGKRRMMVIAVAAGVLFYTGLILFHSRLALMTLQLFNAVFIGIVAGIGMLWFQDLMPGRAGAATTLFTNSISTGVILAGVIQGAIAQSWGHFAVYWVIAVISVIALFLTAKVKDV

SEQ ID NO: 19 - DNA, 1245 bp, Escherichia coli
agtccagttacgctggagtcaagcaagcttaaaatgcataattccccagctgtcacttctgccaagtctttcgatttgactagcatggcattcttgattgttgcttttttgaccggcatcgctggtgccttgcaaaccccaactttgtccattttcttgactgatgaagttcacgctagaccagctatggtgggctttttctttactggttccgccgtcattggtatcctagtctctcaatttttggccggtaggtctgacaaaaggggtgatagaaaatccctgattgtcttctgctgtttgttgggtgttttggcctgtaccttgttcgcttggaacaggaactattttgtcctgttgttcgttggcgtttttctgtcttccttcggttctaccgctaatccccaaatgtttgctttggctagagaacatgccgacaaaactggtagagaggctgttatgttttcttctttcttgagggctcaagtttctctggcctgggttattggtccacctttggcttatgctctggctatgggtttttcctttaccgttatgtatctgtctgctgctgtcgcctttatcgtttgtggtgtcatggtctggttgtttttgccctctatgcagaaagaattgccattggctactggtactgttgaagctccaagaaggaataggagagacaccttgttgctgttcgtcatttgcactctgatgtggggttccaattccctgtacatcattaacatgccactgttcatcatcaatgagttgcatctgcccgaaaaattggctggtgttatgatgggtactgctgccggcctggaaattccaaccatgttgattgctggctattttgctaagagattgggcaagaggtttttgatgagggttgctgcagttggtggtgtttgtttttacgctggtatgttgatggctcattctccagtcatcttgttaggtttgcagttgctgaacgctatcttcatcggtatcttgggcggtattgggatgttgtactttcaggatttgatgccaggtcaagctggttctgctactactttgtacactaatacttccagagttggttggattatcgccggttctgttgctggcattgtcgctgaaatctggaattaccatgccgtcttttggttcgctatggtcatgatcatcgctaccctgttctgcttgttgaggattaaagacgtttaaccgcggcatcactgaccatttaaatcatac

SEQ ID NO: 20 - protein, 393 aa, Escherichia coli
MHNSPAVTSAKSFDLTSMAFLIVAFLTGIAGALQTPTLSIFLTDEVHARPAMVGFFFTGSAVIGILVSQFLAGRSDKRGDRKSLIVFCCLLGVLACTLFAWNRNYFVLLFVGVFLSSFGSTANPQMFALAREHADKTGREAVMFSSFLRAQVSLAWVIGPPLAYALAMGFSFTVMYLSAAVAFIVCGVMVWLFLPSMQKELPLATGTVEAPRRNRRDTLLLFVICTLMWGSNSLYIINMPLFIINELHLPEKLAGVMMGTAAGLEIPTMLIAGYFAKRLGKRFLMRVAAVGGVCFYAGMLMAHSPVILLGLQLLNAIFIGILGGIGMLYFQDLMPGQAGSATTLYTNTSRVGWIIAGSVAGIVAEIWNYHAVFWFAMVMIIATLFCLLRIKDV

SEQ ID NO: 21 - DNA, 1248 bp, Escherichia coli
agtccagttacgctggagtcaagcaagcttaaaatgcaaaagactgctactactccatctaaaattctggacttgacagctgctgcttttttgttggttgccttcctgactggtattgccggtgctctacaaactccaactttgtccattttcttggctgacgaattgaaagctcgcccaattatggtcggtttctttttcactggttccgccatcatggggattctggtttctcaatttttggctaggcattctgataagcagggcgacaggaagttgttgattttgttgtgttgtttgttcggcgttttggcctgtaccttgtttgcctggaacaggaactacttcattttgctgtccactggtgtcttgttgtcttcttttgcttccaccgccaatccacaaatgtttgctttggcaagagaacacgctgatagaaccggtagagagactgtcatgttctctacttttctgagagcgcaaatctctttggcttgggtcattggtccaccattggcttacgaattggctatgggcttttctttcaaggtcatgtatttgactgctgccattgctttcgttgtctgtggcttgattgtctggttgttcttgccatccatccaaaggaatatccccgttgttactcagccagttgaaattttgccctctattcacagaaagcgcgatactagattgctgttcgtcgtttgttccatgatgtgggccgccaacaacctgtacatgattaacatgcccctgttcattatcgatgaattgcacttgactgataaattggctggcgaaatgatcggtatcgctgccggtctggaaattccaatgatgctgattgctggttactacatgaagagaattggtaagaggctattgatgctcatcgccatcgtctctggtatgtgcttctacgcttctgttttgatggccactactcctgccgttgagttggaattgcaaattctgaatgccatcttcttgggtatcttgtgcggtattggtatgctgtactttcaggacctgatgcccgaaaaaatcggttctgctaccactttgtatgctaatacttccagggtcggttggattatcgctggttctgttgatggtatcatggtcgagatttggtcctaccatgctttgttttggttggccatcggtatgctcggtattgctatgatctgcctgttgtttatcaaggacatctaaccgcggcatcactgaccatttaaatcatac

SEQ ID NO: 22 - protein, 394 aa, Escherichia coli
MQKTATTPSKILDLTAAAFLLVAFLTGIAGALQTPTLSIFLADELKARPIMVGFFFTGSAIMGILVSQFLARHSDKQGDRKLLILLCCLFGVLACTLFAWNRNYFILLSTGVLLSSFASTANPQMFALAREHADRTGRETVMFSTFLRAQISLAWVIGPPLAYELAMGFSFKVMYLTAAIAFVVCGLIVWLFLPSIQRNIPVVTQPVEILPSIHRKRDTRLLFVVCSMMWAANNLYMINMPLFIIDELHLTDKLAGEMIGIAAGLEIPMMLIAGYYMKRIGKRLLMLIAIVSGMCFYASVLMATTPAVELELQILNAIFLGILCGIGMLYFQDLMPEKIGSATTLYANTSRVGWIIAGSVDGIMVEIWSYHALFWLAIGMLGIAMICLLFIKDI

SEQ ID NO: 23 - DNA, 813 bp, Brassica rapa
atggtctttattaaggtccatcaattggcttttttgttcggtctgctgggtaatatcgtctccttcggtgttttcttgtctcccgtcccaaccttttacggtatctataagaagaaatcctccaagggcttccaatccattccatacatttgtgctttggcttctgctaccctgttgttgttctacggcatcatgaagacccatgcctacctgattatctctatcaataccttcggttgcttcatcgagatcagctacctgttcctatacatcatctatgccccaagagaagctaggatcttcaccttgaagctgattttgatttgtaacattggcggcttgggtctgttgattctactggttgatctattgatccccaagcaacacagggtttctactgttggttgggtttgtgctgcttattctttggctgtttttgcttctccactgtctgtcatgagaaaggtcattagaaccaagtccgtcgaatacatgccattgttgctgtctttgtctctgactctgaatgctgtcatgtggttcttctacggtttgttgatcgaggataagttcattgccatgcccaatatcttgggttttctgtttggtattgcccagatgatcctgtacatgatgtaccacgactctaagaagactgatctgcccaaattgacctctaccgaaaatcaacccactaacatcactaatctgaacgaagtcgctattgttgccgtcgagttgtctgatgctagagctgaaaatgttgaaggttctgttaggccaatgactccaaattcatctactactgcttaa

SEQ ID NO: 24 - protein, 270 aa, Brassica rapa
MVFIKVHQLAFLFGLLGNIVSFGVFLSPVPTFYGIYKKKSSKGFQSIPYICALASATLLLFYGIMKTHAYLIISINTFGCFIEISYLFLYIIYAPREARIFTLKLILICNIGGLGLLILLVDLLIPKQHRVSTVGWVCAAYSLAVFASPLSVMRKVIRTKSVEYMPLLLSLSLTLNAVMWFFYGLLIEDKFIAMPNILGFLFGIAQMILYMMYHDSKKTDLPKLTSTENQPTNITNLNEVAIVAVELSDARAENVEGSVRPMTPNSSTTA

SEQ ID NO: 25 - DNA, 827 bp, Petunia x hybrida
aagcttaaaatggcccaattgagagccgatgatttgtctttcattttcggtttgttgggcaacatcgtttccttcatggtttttttggctccagttccaaccttctacaaaatctacaagaggaagtcctccgaaggttatcaagctattccatatatggttgctttgttctctgctggcttgttgttgtattatgcctacttgagaaagaacgcctacctgatcgtttctattaacggttttggttgcgctatcgaattgacctacatttccttgtttttgttctacgccccaagaaagtctaagatttttactggttggctgatgttgttggaattgggtgctttgggtatggttatgccaattacttatttgttggccgaaggttcccatagagttatgatagttggttggatttgcgctgctattaacgttgctgtttttgctgctccattgtccattatgagacaagttattaagaccaagtccgtcgagtttatgccattcactttgtctttgttcttgaccttgtgtgctactatgtggtttttctacggtttcttcaagaaggacttctacattgccttcccaaacattttgggtttcttgttcggtatcgtccagatgttgttgtacttcgtttacaaggactccaagagaatcgatgacgaaaaatctgatccagttagagaagccaccaagtctaaagaaggtgttgaaatcatcatcaacatcgaggatgataactctgataacgccttgcaatctatggaaaaggatttctccagattgaggacctctaagtaaccgcggctcgagtcatgtaa

SEQ ID NO: 26 - protein, 265 aa, Petunia x hybrida
MAQLRADDLSFIFGLLGNIVSFMVFLAPVPTFYKIYKRKSSEGYQAIPYMVALFSAGLLLYYAYLRKNAYLIVSINGFGCAIELTYISLFLFYAPRKSKIFTGWLMLLELGALGMVMPITYLLAEGSHRVMIVGWICAAINVAVFAAPLSIMRQVIKTKSVEFMPFTLSLFLTLCATMWFFYGFFKKDFYIAFPNILGFLFGIVQMLLYFVYKDSKRIDDEKSDPVREATKSKEGVEIIINIEDDNSDNALQSMEKDFSRLRTSK

SEQ ID NO: 27 - DNA, 873 bp, Triticum urartu
atgggtggtttgtctatggaacatccttgggctttcgcttttggtctgctaggtaacgtcatttctttttcctctttgttggcccccattccaaccttttacaggatttttaagtccaagtccaccgaaggctttcaatccgtcccatacgtcgttgccttattctctgctatgttgtggatcttttacgccttggttaagactggtgaaggtctgttgatttccattaatgccgccggttgtgtcattgaaactgtctacatcgtcatgtacttggtttacgctcccagaaaggccaaaatctttactgctaagatcgtcgtcttgttgaacatcaccggtttcggtttgatcttcctgttgactttgtttgctttccacggtgaaactagagtcgtttctttgggttggatttgtgtcggtttctccgtctgtgttttcgttgctccattgtctattattggcagagtcatcaagactaagtccgtcgagtatatgccattcaccttgtccttgaccttgactctgtccgccattgtttggtttttgtatggcttgttgatcaaagacaagtatgttgccttgcccaatattttgggcttcaccttcggcgtcatccaaatggttctgtacgtcttctacatgaataaaaccccagtcgcttctgaagttaaggaaggtaaggaagcatggaaggctccagctgaagatcatgttgttgttatcaacgtcggtaagactgataaaggttcttgtgccgaagttagaccagttactgaaatggcttccgctgttgatgttcctagaagatgtgctgctgaagctgctgcagctccaggtgtcgattttgctaggtctgtcgatgttgtttaa

SEQ ID NO: 28 - protein, 290 aa, Triticum urartu
MGGLSMEHPWAFAFGLLGNVISFSSLLAPIPTFYRIFKSKSTEGFQSVPYVVALFSAMLWIFYALVKTGEGLLISINAAGCVIETVYIVMYLVYAPRKAKIFTAKIVVLLNITGFGLIFLLTLFAFHGETRVVSLGWICVGFSVCVFVAPLSIIGRVIKTKSVEYMPFTLSLTLTLSAIVWFLYGLLIKDKYVALPNILGFTFGVIQMVLYVFYMNKTPVASEVKEGKEAWKAPAEDHVVVINVGKTDKGSCAEVRPVTEMASAVDVPRRCAAEAAAAPGVDFARSVDVV

SEQ ID NO: 29 - DNA, 1557 bp, Saccharomyces cerevisiae
atggctccaaaaatttcaatatccttaaacccaccgtacaacggggagttttatagctctaatgatcaaatgtcagggatagttagtcttcagttaacaaaagcgctatctataaggaaaatttccgtcattctaaaaggattctcagagaccttaacaaaaattgatcaagagtacatgtttcaacagaatggcatgatgatgccgggccaagacaacaaatcctttcatacattaatgaaattcgaacagagagttttccctccagataatgtatggaatgctcttgatggctcctccaagccgttcaaagttaaaccaggttcatataattatagctttcaatttgacaagtttcccagaaagcctgaatgtctgaaaaatcatacggcaaagacagtagcgtttgtgacaagaagtaatgcccgactcccacctacgttcaatagtcattggcaagaatttaataaaatcgataatctggatttgtatttttactcttttggaaaagttatatatatggtgcaagttcaattagagctagggaaatcttcatcttggtttaagccattccataaactgataagggaaatcgagacgttcgaatttatacctgagccaaaagatcttattatagaacctgatgaagatgacaatgaagaacttaatgccttcagtaacaatagtagaggaaatagtatggtcaccaacaatgaatttttcaatagttcaaatttaaaggtgccatcaaaggacgtcaaagtcgttaatggagtcggatatataaaaagtgacaggaacttttctcaagctaattctatattgatagaaaacggcgacattagatcgagaccggtatcatcagtcacatcaacaagacaatctactcgcctagtaaatggtatgaaagttttcccatctacttataaaatggggttgcctgatggggaaagcaatatgagaatagaggttagaagtcgagatttgaagcaaatatacaggaaagactacttgtttaggtctggcagccaaaattttgacaaggtctatgtagtcatggaggggaatatagcaagtttgagcaaaatgcaaattaccccacttaaactacaactgaacttgctagagactacaacatatttatctcagggaatagcgaacggcaattactcttctttgaagctaatcgagattgatttgaatcagctcaaatccaataaacctcttttggacttaaacgaaatacgagaaaattttgatggttctatgtttgaatgtgaattacggttaaaggatcaccccattttaagaaagttggtatttaatgaagaagactatagacatcgcggcaataggttgtatagtttcaagacatgcacgataaaaagaacattcagtttacagctactgatagaatggggaatcaatggaattaggaagcaatctgaagtaaacattgatcctgttcagatcttttgtcaagttagagagcacgttgaagctgaagctctgcccagatatgtaccgccaccgacatatactgaaatggcgagttaa

SEQ ID NO: 30 - protein, 518 aa, Saccharomyces cerevisiae
MAPKISISLNPPYNGEFYSSNDQMSGIVSLQLTKALSIRKISVILKGFSETLTKIDQEYMFQQNGMMMPGQDNKSFHTLMKFEQRVFPPDNVWNALDGSSKPFKVKPGSYNYSFQFDKFPRKPECLKNHTAKTVAFVTRSNARLPPTFNSHWQEFNKIDNLDLYFYSFGKVIYMVQVQLELGKSSSWFKPFHKLIREIETFEFIPEPKDLIIEPDEDDNEELNAFSNNSRGNSMVTNNEFFNSSNLKVPSKDVKVVNGVGYIKSDRNFSQANSILIENGDIRSRPVSSVTSTRQSTRLVNGMKVFPSTYKMGLPDGESNMRIEVRSRDLKQIYRKDYLFRSGSQNFDKVYVVMEGNIASLSKMQITPLKLQLNLLETTTYLSQGIANGNYSSLKLIEIDLNQLKSNKPLLDLNEIRENFDGSMFECELRLKDHPILRKLVFNEEDYRHRGNRLYSFKTCTIKRTFSLQLLIEWGINGIRKQSEVNIDPVQIFCQVREHVEAEALPRYVPPPTYTEMAS

SEQ ID NO: 31 - DNA, 2457 bp, Saccharomyces cerevisiae
atggcattttcacgtcttacatctactcatcagtccaatcataacggctacagtaatagcaacaaaaaaggacaaagtcttccactaaccctttctattgatgtagaatcaccgccatgtgttctttatgggtctgctatggaatcctcaggtgctgtgctaagtggactttttactgtgacggttgtcgatccctacagtagtgctgaagataaatctttaaagaatacagaatctaatgtgtcgactacttctaaaagcctaaaaagaaagagtacatttggttctgcactttcatctagattgtccagcttgtcagcgtcgacgtcaaatatctctccttcaacatcttctacatccatatcgcattctcccacgcctgctaatttaagaataatggctggttataccaagatcaccattacgtcggtaacactaagtttggtacagaagatccatttccataaaccctttgtgcctaatatttcctcaatgcaaacctgtatgaactgtaaaacaaagattacaaacatgaaaagctgggaaattcagagtaatacccaggatctttctgttggaagccactcttacccattttcctatcttataccggggtctgtcccatgttcttcatcgctaggtgctacggctgaaacccaggtcaaatacgaacttatcgctgttgtgacgtatatagatcctcatagaaattccttttcttccggtcattctactcccaggaaagaaggaagctcttctaagaagcggttgttgcaactagcgatgcccatcgccgtgactcgaagtataccgcgcgggcctgataagaattctctaagagtatttcctcctacagagttaactgctgctgctgttcttcctaatgttgtatatcctaaatctacttttcctttggagatgaaattagacggtgtttcttcgggggataggagatggcgaatgcgtaaattgagttggagaattgaagaaactacaagagttaaagcacatgcttgtccagtgcacaagcatgaattgaggcagttagaagagcaggttaaaataaaagagtcagaaaaaagtaaaaagccacgcagtcatattaagcgttatggtgaactaggcccacaaatccgggttgcagtaaactctttagaaaatatgccgtcgcaaaggcttccaggcgagcccggtcgtgaacaagcacctaattcttcgggtccagcgtcaactggtaatgttggacttgatgatgaaaatcctgttaatgaagatgaggaagaccaacccggtagcgaattcatccatcccagtgacgacgctttgcgtcaggagttactaatgcagcaacaacgcgcaagacaacaacaacttcaacaagagctaaaaaacaacagtagtttatttacggaagaggttcggataatatctaagggagaaatgaagagtggatggaaaaccgattttgacaataatggaaagattgagctagttacagaaatagattgtatgggacttaattcaggcgtctctaatccggtaatgcatgcatcgacactacaaactccttccacgggcaataagaagcccagcatcaatgtggcttgcgatatacaggatccaaatttaggtttgtatgtaagccacatcttggcagtggaaatagttgttgcagaagaaacattgcaatatgccaatgggcaacctatacggaaaccaaactccaaaaacaagaaagaaactaataacaatacgatgaatgttcataatcctgatcaacgcttagctgaattatctccaatttttgcaaatagaaatacaccgaaagtacggcgcatggggcctgaagatataacaccggtgaatagtaataagtccaaccatagtactaataaggagaaggcatctaacggtgctagtaactctaatatagtgagtgttcccactggtgcagcacgtgttttaagaatgcaattcagattaacagtcactgaaagatctggacttggaatctcctgggacgaagaagttcctcccatttaccaagatgtcgagttgctctcgccaccatgttacgagctctctataaataatggaatcaaaaataaactttattcaacaatgagtactcctgttagatcagaggatgattttgtgggcggcagcgatgaagatattgggaactatgagagccaagggctcgaacctggtcctaacgtacaggaagtaacgatcacacaaaataaattaacgataccaccaaccgcacatcactaccagcctgcttcctcttcgcaaagatcccttaccacagtacagtcaccaccactggaaagtgttgttagtgtccagggtagtgtaccttttcgtggacatgtgttgacaccacatagcacaagagatatcagaatacaaaacttttccgattttctagattccaatagaataacccagtag

SEQ ID NO: 32 - protein, 818 aa, Saccharomyces cerevisiae
MAFSRLTSTHQSNHNGYSNSNKKGQSLPLTLSIDVESPPCVLYGSAMESSGAVLSGLFTVTVVDPYSSAEDKSLKNTESNVSTTSKSLKRKSTFGSALSSRLSSLSASTSNISPSTSSTSISHSPTPANLRIMAGYTKITITSVTLSLVQKIHFHKPFVPNISSMQTCMNCKTKITNMKSWEIQSNTQDLSVGSHSYPFSYLIPGSVPCSSSLGATAETQVKYELIAVVTYIDPHRNSFSSGHSTPRKEGSSSKKRLLQLAMPIAVTRSIPRGPDKNSLRVFPPTELTAAAVLPNVVYPKSTFPLEMKLDGVSSGDRRWRMRKLSWRIEETTRVKAHACPVHKHELRQLEEQVKIKESEKSKKPRSHIKRYGELGPQIRVAVNSLENMPSQRLPGEPGREQAPNSSGPASTGNVGLDDENPVNEDEEDQPGSEFIHPSDDALRQELLMQQQRARQQQLQQELKNNSSLFTEEVRIISKGEMKSGWKTDFDNNGKIELVTEIDCMGLNSGVSNPVMHASTLQTPSTGNKKPSINVACDIQDPNLGLYVSHILAVEIVVAEETLQYANGQPIRKPNSKNKKETNNNTMNVHNPDQRLAELSPIFANRNTPKVRRMGPEDITPVNSNKSNHSTNKEKASNGASNSNIVSVPTGAARVLRMQFRLTVTERSGLGISWDEEVPPIYQDVELLSPPCYELSINNGIKNKLYSTMSTPVRSEDDFVGGSDEDIGNYESQGLEPGPNVQEVTITQNKLTIPPTAHHYQPASSSQRSLTTVQSPPLESVVSVQGSVPFRGHVLTPHSTRDIRIQNFSDFLDSNRITQ

SEQ ID NO: 33 - DNA, 3354 bp, Saccharomyces cerevisiae
atgccgtttataacatcaagaccggtggcgaaaaattcatcccactctttatcagaaacagatttaaaccagtctaaaggacagccgtttcaaccctctcccaccaagaaattagggtccatgcaacaacgaagaagatcctccaccattaggcacgcgctatcatctttacttggtggcgctaatgttcactcacctgccgtcttgaacaacacaacgaaaggcggcaataataacggcaacatcagaagcagcaatacagacgcccaactccttggcaaaaaacagaacaaacagccgccgccaaacgcaaggcgacacagtaccactgccatacagggctctatcagcgatagtgctactacgactccgagatcctcgacttccgacaccaaccgtcgcacttcgggaagattgtcggtagaccaagagcccagaatctctgggggacgctattcacagattgaggaggatagcacagtactagattttgatgatgaccataactcatcagctgtagtgtcaagcgatttatcatcaacttctctaacaaggttggcaaactcgaaaaagtttaacgagcaatttctcatagaatatttaaccgctagaggtctcctgggcccaaaaaccgttctatccaatgagtacttgaagatttctatttctacaagcggtgaaagcgttttcttaccaacgatatcctcgaatgacgatgagtacctgtccagactaaacggactcaatgatggtacggacgatgctgaggcggatttttttatggatggtatagaccagcaagaaggtaacactccatctctcgctacaacggcagcggctaccgaaagtggtggcagcataaatgaaaatagagacacactcctgagagaaaataattcaggagaccatccaggctccggctcggaacttaatacaaggtctgttgaaatcgacagttccatggtctcttacagcatagcagttatagtatccgttaaaaaaccaacccgatttacggacatgcaattggaattatgttcaagggttaaagtgttttggaatacaggtgttcctcctacaaagacgtttaatgaagaattttataatgctgcatcaatgaaatggaatttgaatgatgaaaacttcgatttgtttgtaccattaagcatatccccagatgatcaaatgattgaaaacaactccaacgatcgtcaaatgaggttgttcaagaatattcctacagaggagagactgtatttggacaagactaaaacaaaagccagccttttaaacgccatagacgtaaataagactcatctttaccaacctggagactatgtattcttagtaccagtggttttctctaatcatattccggagactatctatttaccctctgcacgtgttagttacagactaaggcttgcaacaaaggcaatcaatagaaagggtttctatcgtcaagattcaaactctccgcaacctattgtgtcgccagactcttcttcatcactaagctccactacatcttcattaaaacttaccgaaacagaatccgctcaggcccataggaggataagcaacactttgtttagtaaagttaaaaatcatctacacatgagctcacatcaactgaaaaatgaagaatcaggagaagaggacattttcgcagagtatccaataaaagttattagaactccaccgcccgttgccgtatccactgcgaataaaccaatctatattaatagggtttggacagattctttgtcatacgagatttcctttgctcagaaatacgtttcactaaacagtgaagtcccaatcaagataaaattggcaccgatatgcaaaaacgtttgtgttaaacgtattcatgtcagtattactgaaagagtcacatttgttagtaaaggttatgaatatgagtatgatcaaacagatcccgttgctaaagacccttataatccgtattatttagatttcgcctccaagagaagaaaggaaagaagtgtatcattatttgaaatcagaactaaggagaagggcacgagagctctaagggaggaaattgttgaaaattcattcaatgacaatctcttatcttatagtccttttgatgacgacagcgattcaaaaggcaatccgaaagaaaggctcggtataacggaaccaataattattgaaacaaaattgaagttccccaaatacgaagatttggataaaagaaccgcaaagataataccaccttatggtatcgatgcatacacgagcatccccaatcccgaacatgccgtagccaatggaccctcacaccgtcgtcccagtgtaataggctttttatccggtcataaaggctcgaaaagtcatgaagaaaatgaaaaacctgtttatgatccaaaattccatcaaacaataatcaaatccaattctggtttgcccgtgaaaacacataccagattaaacacaccgaaaagaggcttgtacttggatagtttacacttcagtaatgtttactgtagacataagctggaaattatgctacgaatcagtaaacctgatcctgagtgtccgtccaaattaagacattatgaggttctaatcgatacgcccatattcctggtgtctgaacagtgcaacagtggtaatatggagttacccacttatgatatggccacaatggaaggcaaaggcaaccaggttcctctaagtatgaacagcgacttttttggtaacacatgtccacctccgccaacttttgaagaagccatatccgttccagcttctcccattgtctcaccgatgggatcacctaatatcatggcctcgtatgaccctgatttactatctattcaacaattgaacttatcaagaactacgtcagttagtgggccatccggatacagcgatgatgccggtgtgccaaatgttaatcggaacagtatttcaaatgccaatgccatgaacggcagtatttcgaattccgcatttgtttcgggcaatagtggccaaggtgttgctagagcaagagcaacgtcagtgaatgacaggtcaagattcaataatctcgataaattattgagcactccatcgcccgtcaatagatctcacaattcatcaccaacaaatggcttatcacaagcaaatggtactgtgaggattccaaacgctaccactgaaaactctaaggacaaacagaacgaatttttcaaaaagggttacactttagcgaatgtaaaagatgatgaagaacaagaaggaatagtaagttcgagctccgcagattcgctactctctcatggtaacgagcctccgcgttatgacgaaatagtgcctttgatgagtgatgaagaatga

SEQ ID NO: 34 - protein, 1117 aa, Saccharomyces cerevisiae
MPFITSRPVAKNSSHSLSETDLNQSKGQPFQPSPTKKLGSMQQRRRSSTIRHALSSLLGGANVHSPAVLNNTTKGGNNNGNIRSSNTDAQLLGKKQNKQPPPNARRHSTTAIQGSISDSATTTPRSSTSDTNRRTSGRLSVDQEPRISGGRYSQIEEDSTVLDFDDDHNSSAVVSSDLSSTSLTRLANSKKFNEQFLIEYLTARGLLGPKTVLSNEYLKISISTSGESVFLPTISSNDDEYLSRLNGLNDGTDDAEADFFMDGIDQQEGNTPSLATTAAATESGGSINENRDTLLRENNSGDHPGSGSELNTRSVEIDSSMVSYSIAVIVSVKKPTRFTDMQLELCSRVKVFWNTGVPPTKTFNEEFYNAASMKWNLNDENFDLFVPLSISPDDQMIENNSNDRQMRLFKNIPTEERLYLDKTKTKASLLNAIDVNKTHLYQPGDYVFLVPVVFSNHIPETIYLPSARVSYRLRLATKAINRKGFYRQDSNSPQPIVSPDSSSSLSSTTSSLKLTETESAQAHRRISNTLFSKVKNHLHMSSHQLKNEESGEEDIFAEYPIKVIRTPPPVAVSTANKPIYINRVWTDSLSYEISFAQKYVSLNSEVPIKIKLAPICKNVCVKRIHVSITERVTFVSKGYEYEYDQTDPVAKDPYNPYYLDFASKRRKERSVSLFEIRTKEKGTRALREEIVENSFNDNLLSYSPFDDDSDSKGNPKERLGITEPIIIETKLKFPKYEDLDKRTAKIIPPYGIDAYTSIPNPEHAVANGPSHRRPSVIGFLSGHKGSKSHEENEKPVYDPKFHQTIIKSNSGLPVKTHTRLNTPKRGLYLDSLHFSNVYCRHKLEIMLRISKPDPECPSKLRHYEVLIDTPIFLVSEQCNSGNMELPTYDMATMEGKGNQVPLSMNSDFFGNTCPPPPTFEEAISVPASPIVSPMGSPNIMASYDPDLLSIQQLNLSRTTSVSGPSGYSDDAGVPNVNRNSISNANAMNGSISNSAFVSGNSGQGVARARATSVNDRSRFNNLDKLLSTPSPVNRSHNSSPTNGLSQANGTVRIPNATTENSKDKQNEFFKKGYTLANVKDDEEQEGIVSSSSADSLLSHGNEPPRYDEIVPLMSDEE

SEQ ID NO: 35 - DNA, 3141 bp, Saccharomyces cerevisiae
atgcccatggaccaatctatctcatctccattgtttcccatggaaaaggatattgatatccccctcgatgctacacccttggcacaaagttcatcattacagctttttattcatttagctgaaccagttgttttcctccaaggctttgaccctcagaagacggaatatccctcggttgttcttcggggctgtctagtggtaagaatactgaaacccacaaagctgaaaagcataagtctttcgttcaaaggatattctagaactgaatggcctgaaggtatccctcctaaaagacaagaattcgtggaaatcaaagatattgtagaccatacatgggctctatatccgccaactgaacagaagagcaagaaaaagatggatgcttccgcacctaatgagagcaacaatgcagctaataattttttgacgaaggaaagtggtgcctctctttatagaacactgtctgataatgaaactataacaagcagaaaaaattctatatcaggtttgtcctcgttgaacttgtcacctctaggtgcacctggaaattcctctgtcaacgtaaaagacagagaaagtagacaaagatctagatcttcgtcagtcacttcttccaatggaccatcaagaaacctatccccgataaatttattgaagagagccacgtctccttccgtgtctcaccacaactataaacctacgaccacttccatcttttccgacttgttgaataacacctttacccataatgatgcagcatcgcatcatggtcatcatatccccaccagtagcaatcatctggcaatgacaagcaacaacttcaccagcgggtctggaggagaattttttgtctttcaaccaggcgactatatttatgctttcgaagaactaattcctcaagcatacccagaatctattaaagctgatttcggatttgtggaatacttcttatttgccagtatagagagacctggtgcctttaaatcaaacattagcgcccggcaagtggttaatatcgtacggacacaggctcataattctgtggaagaaagtgagccgattatcatatctagagattgggaaaaccaattatattatgatatcgttatagcatcaaaggatattattttagatgcttttctgcctatcacgttcaaattcgctcccctcgataaagttacgttgcatagaataagaatttatgtgacagagacaatggagtattattgtagagaaaagaaggttcataggatggagcccaccaagaaatttttattgacagaacagaaaggtcctaaattaccgaacttgcccaatgatgcaaatttgtcaaaggccaagaatatggggaacctgttgcaggatccaaagaatggtgatttagtgaataaagagtatgagtaccagatttttattccgagtcgtttcaacaaccatcagcaattgcatccagatacttcttatgaaaacatcaaagcaaaccattggattaaaatttgcctgagactgtctagagtagtagataataaaaggaaacattacgaaattagtattgactcgccaatacatgttttacatagattgtgctcgcatgcaaatacccttttaccgagctatgatggacatcctgcttcttttccaaaagaaacagattcctcaatttcctcaatattggaatcgtctgatgacaatataaatctataccataactctaatattttctttcccaaggaagtcctttcgtctccagtactttcgcccaatgtccaaccattagacattttaatcccacatttaccttccacttcattgaccagaaactctaggcaattcaataggaactcaaaatcccatccgagtgataataccatcttcaattctgcaaagttgaaatccaacatatatcaaccggagagtttgcaaagagaattagcatcaccccaggcaatcccgctctctccaataacatcgccaatgtcaaatatggaagtgcctccgccagattttgacttttcttccgatttcatatctgatgctgcttccggaaccactactactgaggtatcttcatcagagtcgagcatcttaccacgggatccaccatcttataaggatactgtgttgcatgacaacaatcaaaaaaggaggcctaattccaaacatccgacgcctccaagtttaaaagcttcccatccaaataaaaattcggataagaattcttcagaaactttgaataaaaaagaatcgatgtcaaagatagaagaaaataaacacaaaagagagacaactcctaaaaagagagaaaatagggacgtgaaaagtttatcaaccccacaacgcgaggaaagcaaagactcgacatccactgggaatcaaagtaacgaaaagaacagaaaaagagtattaagcctatcgtcttcattacatagctcaccaaataatagcggatttgcgcattcagctttaggaaatctgagcaatgaatcattaagatcattgaatagaagggaaagtgttcaagataatttaccgtccacaataagacacgataatccttttttcacagatttaaatcaagttttaatagaagacgaacttaaaaatcatgataaaaatgaactaaatcgacattctacaaatacttcgagcacccccgcctcagctagatcctcttttgactattcaggaattaatataagcaaggacaagttgaacatggaaccattactgagtaaaacggaaacgttgactaataaagttaatgaagactcctttttaaggcctaatgattcatacgttgatctacttgaaccctcagtagatactacgattgatatcactgcgccgtacgctagaaattcctctgcttggcatcctttacaaaacgataacgataacaatcagttttctccacttttgggaagtaacgagaatttcttgaatgcagctaatgcacaaaattctgccgaatcagatcataataatgacattttcacacagggctcaggattaacggaaagctctaagaattctgattccgaggaaagatttatttcaagactttcttcacccgagaaagtactgattaatacgttagataatgaatctggattacaaagtataaatgagagtaccctttag

SEQ ID NO: 36 - protein, 1046 aa, Saccharomyces cerevisiae
MPMDQSISSPLFPMEKDIDIPLDATPLAQSSSLQLFIHLAEPVVFLQGFDPQKTEYPSVVLRGCLVVRILKPTKLKSISLSFKGYSRTEWPEGIPPKRQEFVEIKDIVDHTWALYPPTEQKSKKKMDASAPNESNNAANNFLTKESGASLYRTLSDNETITSRKNSISGLSSLNLSPLGAPGNSSVNVKDRESRQRSRSSSVTSSNGPSRNLSPINLLKRATSPSVSHHNYKPTTTSIFSDLLNNTFTHNDAASHHGHHIPTSSNHLAMTSNNFTSGSGGEFFVFQPGDYIYAFEELIPQAYPESIKADFGFVEYFLFASIERPGAFKSNISARQVVNIVRTQAHNSVEESEPIIISRDWENQLYYDIVIASKDIILDAFLPITFKFAPLDKVTLHRIRIYVTETMEYYCREKKVHRMEPTKKFLLTEQKGPKLPNLPNDANLSKAKNMGNLLQDPKNGDLVNKEYEYQIFIPSRFNNHQQLHPDTSYENIKANHWIKICLRLSRVVDNKRKHYEISIDSPIHVLHRLCSHANTLLPSYDGHPASFPKETDSSISSILESSDDNINLYHNSNIFFPKEVLSSPVLSPNVQPLDILIPHLPSTSLTRNSRQFNRNSKSHPSDNTIFNSAKLKSNIYQPESLQRELASPQAIPLSPITSPMSNMEVPPPDFDFSSDFISDAASGTTTTEVSSSESSILPRDPPSYKDTVLHDNNQKRRPNSKHPTPPSLKASHPNKNSDKNSSETLNKKESMSKIEENKHKRETTPKKRENRDVKSLSTPQREESKDSTSTGNQSNEKNRKRVLSLSSSLHSSPNNSGFAHSALGNLSNESLRSLNRRESVQDNLPSTIRHDNPFFTDLNQVLIEDELKNHDKNELNRHSTNTSSTPASARSSFDYSGINISKDKLNMEPLLSKTETLTNKVNEDSFLRPNDSYVDLLEPSVDTTIDITAPYARNSSAWHPLQNDNDNNQFSPLLGSNENFLNAANAQNSAESDHNNDIFTQGSGLTESSKNSDSEERFISRLSSPEKVLINTLDNESGLQSINESTL

SEQ ID NO: 37 - DNA, 2514 bp, Saccharomyces cerevisiae
atgttttcatcatcatctcgaccttcaaaagagccattactatttgacatcagacttagaaatttggacaatgatgttttactgataaaaggcccccctgatgaggcatcttctgtcctactatctggaactatagtattgtcaattactgagccaattcaaatcaagtctttggctttgagactttttggtaggttgagactaaatattccaacggttttacaaactgttcatgggccgcataagcgatactcaaagtttgagagaaacatatattctcatttttgggatgattttaatataaaaagttatttccaaaacttgtacgataatcataataatggtaaaataacaatttctagtaaatcctcaacaaatttagcagcattgccaaagagaaaaagagccctttctactgcatcattgatatcaagtaatgggcagacaagcgcaagcaaaaactatcacaccttagtaaaaggtaactacgaattccctttcagcgcgattattcctgggtcattagtggaaagtgtagaaggcctaccaaatgctgccgtcacttatgctctggaagctactatcgagagacctaagcagcccgacttgatctgtaaaaaacatctaagagttattcgaacgttagctatagatgcagtcgagttatctgaaacagtatcagtggataactcatggcctgaaaaagtcgattatacgatctccattccaactaaggcaattgccattggctcttccaccatgatcaatattttaattgttcctatattaaaaggattgaagttaggccctgttaggatcagtttggtggaaaattcccagtattgtggtagctatggaggggttatcaaccaagaaagaatggtggctaaattaaaactaaaagatcccctgaagcacgttgcccaaataaagaagaagaggagcctaaatgaagctgccgacgaaggggttgatacggacacaggggaatttcaagataaatgggaagttcgagctttattaaacatacctgcaagcctgactaaatgctcccaagactgtcgcattttatctaatatcaaagtccgtcataagatcaagttcactataagtttactcaatccggacggtcatatttcagaattgcgtgcggcactgcctgtccaattattcatttcaccgtttgttccagtcaatgtaaagacctccgatgttattgaaagaacgctcaaaacgtttggaccctcatatcaagtaacaagtcagcacgataattcattcagcagcaaaaactttgtagacgatagtgaagaagatgtgatttttcaaagatctgcttctgcgttacaattgtcttcaatgccaaccatagtatctggctctactttaaatatcaatagtactgatgcagaggctaccgcagtcgctgacacaactatggtaactagtttgatggtacctcccaactacggcaatcacgtttacgatcgagtgtatggcgaggtaactaatgaagacgaaacttcagcatcagcttcttcaagtgccgtcgaatcacaggcaattcacaatattcaaaacctatatatatcggatagtaacaatagcaataatcctattttggcaccaaatcctcaaatcaagattgaagatgatagcctaaataattgtgactctcgaggggacagcgttaacaatagtaacctgaatctggttaatagtaatctaacaattagtgaaaattggaacaataactctccttctgcaaatagatataataacatcattaatgctggattgaatagtccttcactgacaccaagctttgcacatttatctaggcgtaactcatatagtcgccaaacatcttctacatcgctgaagaacgatttggaactgacagatttaagcagagttccctcgtatgataaagcaatgaaatctgatatgattggtgaggatcttccaccggcttatcccgaggaagaacttggagttcaagaaaataaaaaaattgaactagaaaggccacaaattcttcatcacaagtctacatcctctttgttgccacttccaggctcgagcaagagttccaataatctgaaaagatcgtctagtaggacacatttatcccactctccattaccaaggaataatagcggatcctcagtatcattgcagcagttggcgagaaacaacacagatagttcatttaatctaaatctctctttcacttcagcaaaaagcagcacaggaagcagacattttccgtttaatatgacaacatctttcactagtaattcaagttccaagaacaattcacattttgataaaactgattctacatctgacgctaataagccaagagaagaggaaaactatacgagcgcaacccacaatcgaaggtcacgctcatcgtcagttcggagcaacaatagcaactcaccattaagacaaggaacaggttcatttgctaatttaatggagatgttcacaaaacgggatcgctcatag

SEQ ID NO: 38 - protein, 837 aa, Saccharomyces cerevisiae
MFSSSSRPSKEPLLFDIRLRNLDNDVLLIKGPPDEASSVLLSGTIVLSITEPIQIKSLALRLFGRLRLNIPTVLQTVHGPHKRYSKFERNIYSHFWDDFNIKSYFQNLYDNHNNGKITISSKSSTNLAALPKRKRALSTASLISSNGQTSASKNYHTLVKGNYEFPFSAIIPGSLVESVEGLPNAAVTYALEATIERPKQPDLICKKHLRVIRTLAIDAVELSETVSVDNSWPEKVDYTISIPTKAIAIGSSTMINILIVPILKGLKLGPVRISLVENSQYCGSYGGVINQERMVAKLKLKDPLKHVAQIKKKRSLNEAADEGVDTDTGEFQDKWEVRALLNIPASLTKCSQDCRILSNIKVRHKIKFTISLLNPDGHISELRAALPVQLFISPFVPVNVKTSDVIERTLKTFGPSYQVTSQHDNSFSSKNFVDDSEEDVIFQRSASALQLSSMPTIVSGSTLNINSTDAEATAVADTTMVTSLMVPPNYGNHVYDRVYGEVTNEDETSASASSSAVESQAIHNIQNLYISDSNNSNNPILAPNPQIKIEDDSLNNCDSRGDSVNNSNLNLVNSNLTISENWNNNSPSANRYNNIINAGLNSPSLTPSFAHLSRRNSYSRQTSSTSLKNDLELTDLSRVPSYDKAMKSDMIGEDLPPAYPEEELGVQENKKIELERPQILHHKSTSSLLPLPGSSKSSNNLKRSSSRTHLSHSPLPRNNSGSSVSLQQLARNNTDSSFNLNLSFTSAKSSTGSRHFPFNMTTSFTSNSSSKNNSHFDKTDSTSDANKPREEENYTSATHNRRSRSSSVRSNNSNSPLRQGTGSFANLMEMFTKRDRS

SEQ ID NO: 39 - DNA, 2748 bp, Saccharomyces cerevisiae
atgctccaattcaatacagaaaatgatactgtagctccagtgtttcccatggagcaagatataaatgcagcacctgatgccgtcccactggtgcagacaacaacactacaagtctttgtaaagcttgccgaacccatagtgtttttaaaaggatttgaaactaacggactgtctgaaatagcccccagtatcttacgaggatctcttatcgtcagggtgttgaaaccgaataaattaaaaagtatatcgataaccttcaaaggaatatccagaacagagtggccggaaggtataccaccgaagagagaagaattttcagatgttgaaactgttgtcaatcacacatggccattttatcaggcggatgacggcatgaattctttcaccttagaacatcacagctcaaataattcgtccaatcgcccatctatgagcgatgaagattatctacttgaaaaaagcggtgcttcagtatatatcccaccaaccgctgaaccccctaaagataatagcaatctaagtctggatgcctatgagcgcaactcattgtcatccgataatttgagtaacaagccagtatcaagtgatgtttcccatgacgacagtaaactgttggctattcaaaagacaccattaccatcatctagtcgaagaggatcggtaccggcaaattttcacggtaactctttgtcacctcataccttcatatctgatttgtttacaaaaacattcagtaatagtggcgctactccaagtcctgagcaagaggataactatcttacaccatccaaagattctaaagaagtttttatttttcgaccgggcgattatatttacacttttgaacagccaatatcgcaatcttatccagaaagtataaaagccaattttggttccgtggagtataaactgtcaatagacatagagaggtttggcgcattcaaatcaactatacatactcaattacccatcaaagtcgtaaggcttccttctgatggatccgtagaagagactgaagctattgcaatttccaaggactggaaagatcttcttcattatgacgtggtaattttctcgaaagagatcgttttgaatgcatttttacccatcgatttccatttcgctcctctagataaagttactctgcatcgtattagaatttatctaacagagtctatggaatacacttgtaatagtaatggaaatcacgagaaggctcgtagattagagccaactaaaaagtttctgttggctgaacataacggtcctaaactgcctcatataccagctggttcgaatcctttgaaggctaaaaatagagggaacatcctcttggatgaaaaatccggcgatctagttaacaaagattttcagttcgaggtgtttgtcccaagcaagtttacaaacagtatacggttacaccctgatacaaattatgataaaatcaaagcccaccattggataaaaatttgccttcgtctttccaagaagtacggggacaatagaaaacatttcgaaataagtattgattctccaatccatattttaaatcaactatgctcacacgcgaatactttgctaccgagctacgagagtcatttccagtattgtgatgaagatggtaatttcgcaccagcagcagatcaacaaaattacgcaagtcatcatgattccaatattttcttcccaaaagaagttctttcgtctcccgttctttcacctaacgtgcagaagatgaacattagaataccgtctgatcttccagtagtgcgtaatagagctgaaagcgtaaagaaaagcaagtcagataatacctccaagaagaatgatcaaagtagcaatgtcttcgcatccaaacagctggtcgcaaacatttataagcccaatcagattccaagagaattaacttctcctcaggcgttaccattatcgcccatcacctcaccaattctcaattaccaaccattatcaaactccccgcctccagattttgattttgatctagctaagcgcggcgcagccgattctcatgctattcctgtggatcctccatcatattttgatgtattaaaggccgatgggattgaattgccatactacgatacaagttcatctaaaattcctgaactaaaactaaacaaatctagagagacattggccagcattgaggaggactcattcaatggttggtctcaaattgatgacttatccgacgaagatgacaatgatggcgatatagcatctggtttcaacttcaagctgtcaaccagtgctccgagtgagaacgttaattcacacactcctattttgcagtctttaaacatgagtcttgatgggagaaaaaaaaatcgtgccagtctacacgcaacatcagtgttacctagtacaataagacagaacaatcagcatttcaatgacataaaccagatgctaggcagtagtgacgaagatgcctttcccaaaagccaatcattaaatttcaataagaaactaccaatacttaaaattaatgataacgtcatacaatcaaacagcaatagtaataacagagttgataatccagaagatacagtggattcttcagtcgatattacagcattttatgatccaagaatgtcatcagattccaaatttgattgggaggtaagcaagaaccatgttgacccagcagcctactcggttaacgttgctagtgaaaaccgtgtactggacgactttaagaaagcatttcgcgaaaagagaaaataa

SEQ ID NO: 40 - protein, 915 aa, Saccharomyces cerevisiae
MLQFNTENDTVAPVFPMEQDINAAPDAVPLVQTTTLQVFVKLAEPIVFLKGFETNGLSEIAPSILRGSLIVRVLKPNKLKSISITFKGISRTEWPEGIPPKREEFSDVETVVNHTWPFYQADDGMNSFTLEHHSSNNSSNRPSMSDEDYLLEKSGASVYIPPTAEPPKDNSNLSLDAYERNSLSSDNLSNKPVSSDVSHDDSKLLAIQKTPLPSSSRRGSVPANFHGNSLSPHTFISDLFTKTFSNSGATPSPEQEDNYLTPSKDSKEVFIFRPGDYIYTFEQPISQSYPESIKANFGSVEYKLSIDIERFGAFKSTIHTQLPIKVVRLPSDGSVEETEAIAISKDWKDLLHYDVVIFSKEIVLNAFLPIDFHFAPLDKVTLHRIRIYLTESMEYTCNSNGNHEKARRLEPTKKFLLAEHNGPKLPHIPAGSNPLKAKNRGNILLDEKSGDLVNKDFQFEVFVPSKFTNSIRLHPDTNYDKIKAHHWIKICLRLSKKYGDNRKHFEISIDSPIHILNQLCSHANTLLPSYESHFQYCDEDGNFAPAADQQNYASHHDSNIFFPKEVLSSPVLSPNVQKMNIRIPSDLPVVRNRAESVKKSKSDNTSKKNDQSSNVFASKQLVANIYKPNQIPRELTSPQALPLSPITSPILNYQPLSNSPPPDFDFDLAKRGAADSHAIPVDPPSYFDVLKADGIELPYYDTSSSKIPELKLNKSRETLASIEEDSFNGWSQIDDLSDEDDNDGDIASGFNFKLSTSAPSENVNSHTPILQSLNMSLDGRKKNRASLHATSVLPSTIRQNNQHFNDINQMLGSSDEDAFPKSQSLNFNKKLPILKINDNVIQSNSNSNNRVDNPEDTVDSSVDITAFYDPRMSSDSKFDWEVSKNHVDPAAYSVNVASENRVLDDFKKAFREKRK

SEQ ID NO: 41 - DNA, 2202 bp, Saccharomyces cerevisiae
atgggcttcagtagcggtaaatcaactaagaaaaagcctctgcttttcgatatcagacttaaaaatgttgacaacgatgtaatactcctcaaaggtcctccaaacgaggccccctcggtgcttttatctggttgcatcgttttatcgattaacgaacccatgcagatcaaaagcatatcattgagactttatgggaagatacaaatagacgtaccattagagaggccccaggacgctagttcttcgtcgttgtcttcatcgccgccaaagatcagaaagtacaacaaagttttttataattacgcatgggataatgttaacctcaaggagtatctgagtggtttaagagggcaatctggccttgcgggcagtagctcatcaagtaatatcttgggcactcgccaaagagctcagtccacaagttccttgaagtctttaaaggggtcctcctcaccctcttcatgtactttagataagggcaactacgattttccctttagtgctattttgcctggttcgttaccagagagcgtagaatctttgccaaattgcttcgtgacatatagcatggaatccgttattgaacgcagcaaaaattatagtgatttgatctgtaggaaaaatattagagttctgagaaccatttcacccgcagcagtggagttatcagaaactgtttgtgtagataactcatggcccgacaaagtggattattctatttcagtacccaacaaagccgtagctattggttcagccacccctataaatatttccattgtacctctttcgaaaggtttgaaattgggctcaatcaaagtcgtattatttgagaattatcaatattgtgaccccttccctccagtaatttctgaaaataggcaagtgacagaactaaatcttgaagatcccttgaacgagtcatctggagaatttaatggtaatggttgctttgtaaataaccccttttttcagcctgatcattcattccaagacaagtgggagattgataccatcctgcaaatcccgaacagcttatcaaactgtgtgcaagattgtgatgtccgctctaacattaaggttcgccataagctcaaatttttcatcatcctaattaacccagatggtcataaatctgagttaagagcgtccttaccgattcaactttttatttcaccatttgtggcactttcaataaaaccattgtcatcctcgaatttgtattcgctttttagcaccactaaccagaaagacgaaaactcatcacaagaagaggaagaggaatatctgttttctagatcagcatcagtcacagggttggaattattagcggatatgcgtagcggtggctctgttcctaccatttcagacttgatgacgcccccaaattatgaaatgcacgtatatgatcgtctttatagcggttctttcactcgcacggctgtggaaacgtctggaacatgtactcctttgggaagcgaatgttcgactgtcgaggatcagcaacaggatttagaagatttacgtatacggttgacaaaaattagaaatcaacgtgacaatctagggctaccaccgtctgcctcgtctgctgccgcttccagatcgctatctccattactaaacgttccagcaccagaggatggcacggagagaatcttacctcagagtgctcttggtcccaatagtggctctgtgccaggagtacatagtaacgtatcacctgttttactttcaagatccccagccccaagcgtgtcagcccatgaagtgttaccagtgccctcgggcttaaattatccagagactcaaaacctgaacaaggttccatcgtatggcaaggcaatgaaatatgatatcattggtgaggaccttcctccttcctacccttgtgcgatacaaaatgtgcaaccaagaaaacccagtagggtacattccaggaactcttcgacaacattgtcatcttctataccaactagctttcattcctctagttttatgagtagcactgcttcccctatttccataattaatggctctagaagtagttctagtggggtatctcttaatacacttaatgagttaacttcgaaaacttcgaataacccatccagtaatagtatgaaaaggtcaccaacaagacggagggctacttctttagctgggtttatgggaggttttctatcaaagggtaacaaacgatag

SEQ ID NO: 42 - protein, 733 aa, Saccharomyces cerevisiae [sequence omitted]

SEQ ID NO: 43 - DNA, 3366 bp, Saccharomyces cerevisiae
atgcaatctactgtcccaatagcaattgcgagcaacggcaacaagagagatgtcgtccagaacgtttctgcaggcgacgagggtgatatattgcaaaggctagcccgtaacagagagatgatttctacctccctctcgccacaaaaatcgtcaggatttagtggtagaaggaggtcatctagtgttagggacgccctttcttctttttttggaactggtaatagtccaacatctagtatggacgattattccaatttgatgaaccgtaactattctaccgcatcaactgccatgtgtagggggaacagttttccttcagatgttggcactaaggcttacaatattacgggatcttaccaaccggataggcacaggaattctgttccgtataccaccatagaccagttacacacaaggcaagacaccgggttgaggagagagtcagatccagtcgcggcaaaacaaatatctagtaataatgatattgttaggtcattcataacacatcatgctagtaatagcactatgtttattaatagggtgctatcggactatttagcggatcgtggtttcatcaagcaaacaccgttatataataagaaaagtgtgctggaaatttccattgcaacaagtgcagaatcagttttcttgccaactacaaaaagtgatgaaacagagtatctatcactgattcatggttctttaaatcaggcgcgaacacagcctgtcgggtccactaacactgcagaaagtgatttcctcccttcatgtcctacgatggacactttgaatgaaaacaatgatttatcactatttccgttacatacacagcgaaccagcccctctaatacagcaaggacaggtaatgctatggatacaagcaattctgatcgtgcttctccggcctcgaacaataacacaacagatgcggattcctttgttgcgagtggcaataacaaccctatgaataataacaattctcccgcgagaaacagacatcctaattctcactcgcgttctcttcctaatgcttggaatagccaaatgccttcattcagctttgcattgatattttccctgaataaatcaactaccctttctgatattaaagtagaactcacttctaacgtgagagtggtgtggttcaatggtcttccccctaccaagaatgttaacgaggaatgctataatataggttctttggactggaccttaaatgcagacaactttaatcttttcattccgcaaggcgcaaagtctcctcttgatatcgttgaaaatcattccaataacaggaaattgaaagtgctccagaaattatcgatgaggaaacgccgttctttctcgaataaagcagttcttagggaaaatatattaaacaatttaaatgcctcgaattctacgaacaagttaaatgctggtgtttatgtctttactatccccatagtgcttgccagtcgtattcctgaatcgctttactacccatcagcgagggtatcctacagcttaagattagcgacaaaattgaaggatgaacatacacagttggttgcatcacggccacgttcttcttctatctcttctcctcaaaaactgcgttcatattcctgttctgattcttatgaatattctcaaattgatgacaccatagaaggagaaacctacaataacgacaaaaattctactggaaaaatcgcatttccctcctcatggttaaaaagtgcgaaggggcgcttaaaaaggaataattctaacggaaggtcagataataatggcgcatcttctagtggtttagcgatgcaacatgattctgaagacactataaatttacagtacccgcttaatttggtgagaactccgccagaaatctctgtcactacagcaaataagccactttacattaacaaggtttgggagaattgtctttcttatgaaatttcattcgcccaaaagtatgtgcccttgaatggtgaaattccaatcacaattaaagtggcacctctagtaaaaagtcttagtgtcaagagaattcgtgttagttgtagagaaaaaatctcctacaggagtaaagactatcaatatgattttgaccagttggatccattggcttcagatccttgcaatccctatcatatgagatatttagtgagaaaaaagaaggacagaagcttgcctctatttgaggtggcctctaaatgtactagtgggccttctattagagaggaagttgtcaccaatacagttgatgataacttattagcctacacttcatcaaaagaaaacaacaaagatatcccattttctgagtcctttactgttaaaacgaagttaaaatttccaaaatattgtgaagtggacgctaccaaagctgcaagtctaccaccatatggtatcgatcttttcgacccaataaaagatccaactcagagtgagaacacctctaataacggcaatgtattgggctttctagtgggtcgccctaacagggcttccaagacagttcataaaataccgcaagacaagaatcataatgaggtcaatgatacaaatggaaactcgaatacatctttgcaaactagctcgaatgttcccattcagcactacacacggttgaataaaccaagacgcggtttatatttggacagtatgcattttaagaatatccaatgttctcataaattagaaatcgtcttgagggttagcaaaactgatagtggtagctcaaaaatcataaggcattatgaagtaattgttgatacaccaatttatttgatttctgacctttgtaacacttcaaatatagacttaccgacttatgacatggccaccactgaatcttctaaagtcctgccaccaacttttgaagaggcaacatcagtttcagcatcaccaagatcttctgtatcttattatcccgatgacatttccatgcaacagttgaatttgtctaggtcgacttccctcgcaaatggttacctgtcaaccttacatccaaaaacaaccgctgtttcggactcgtctaacggtgccccaatccgggaccagcaagagcaacaagcacgccccttgaggactgaagattatgcgctacaaatggggaatgaaaataacgcctatagcaatatggacggtttgctttcgcaggatatctttgaacaggagaccgcggccacgctatttaaaagagacattgtcacaatgaactttaacaataatatattcacaccacggtatagtccgcgcacttttaccaataccgactacaattataatgataatgataataatgataatgatacagaggggcctggtccaataattcatccgggtcctgaaccaccaagatatgacgagatttcatcataa

SEQ ID NO: 44 - protein, 1121 aa, Saccharomyces cerevisiae
MQSTVPIAIASNGNKRDVVQNVSAGDEGDILQRLARNREMISTSLSPQKSSGFSGRRRSSSVRDALSSFFGTGNSPTSSMDDYSNLMNRNYSTASTAMCRGNSFPSDVGTKAYNITGSYQPDRHRNSVPYTTIDQLHTRQDTGLRRESDPVAAKQISSNNDIVRSFITHHASNSTMFINRVLSDYLADRGFIKQTPLYNKKSVLEISIATSAESVFLPTTKSDETEYLSLIHGSLNQARTQPVGSTNTAESDFLPSCPTMDTLNENNDLSLFPLHTQRTSPSNTARTGNAMDTSNSDRASPASNNNTTDADSFVASGNNNPMNNNNSPARNRHPNSHSRSLPNAWNSQMPSFSFALIFSLNKSTTLSDIKVELTSNVRVVWFNGLPPTKNVNEECYNIGSLDWTLNADNFNLFIPQGAKSPLDIVENHSNNRKLKVLQKLSMRKRRSFSNKAVLRENILNNLNASNSTNKLNAGVYVFTIPIVLASRIPESLYYPSARVSYSLRLATKLKDEHTQLVASRPRSSSISSPQKLRSYSCSDSYEYSQIDDTIEGETYNNDKNSTGKIAFPSSWLKSAKGRLKRNNSNGRSDNNGASSSGLAMQHDSEDTINLQYPLNLVRTPPEISVTTANKPLYINKVWENCLSYEISFAQKYVPLNGEIPITIKVAPLVKSLSVKRIRVSCREKISYRSKDYQYDFDQLDPLASDPCNPYHMRYLVRKKKDRSLPLFEVASKCTSGPSIREEVVTNTVDDNLLAYTSSKENNKDIPFSESFTVKTKLKFPKYCEVDATKAASLPPYGIDLFDPIKDPTQSENTSNNGNVLGFLVGRPNRASKTVHKIPQDKNHNEVNDTNGNSNTSLQTSSNVPIQHYTRLNKPRRGLYLDSMHFKNIQCSHKLEIVLRVSKTDSGSSKIIRHYEVIVDTPIYLISDLCNTSNIDLPTYDMATTESSKVLPPTFEEATSVSASPRSSVSYYPDDISMQQLNLSRSTSLANGYLSTLHPKTTAVSDSSNGAPIRDQQEQQARPLRTEDYALQMGNENNAYSNMDGLLSQDIFEQETAATLFKRDIVTMNFNNNIFTPRYSPRTFTNTDYNYNDNDNNDNDTEGPGPIIHPGPEPPRYDEISS

SEQ ID NO: 45 - DNA, 2931 bp, Saccharomyces cerevisiae
atggccaaagatttgaacgattcggggtttccaccgaagaggaagcctttgctgcgtcctcaacgatctgattttaccgcaaatagttcgacaactatgaacgttaatgcaaacacaagggggcgtggtaggcagaaacaagagggtggtaaaggcagttcgaggtcaccgtcgttacactctccaaaatcatggataagaagcgcgtctgctacggggatccttggactaagacgtcccgaactagcacattctcattcgcatgctccttccaccggaacgcctgctggaggtaatcgttctcctttgagaagatcaactgcaaatgcgacccccgtcgagaccggaaggtccttgaccgacggagatatcaacaatgttgttgatgtactgccctcatttgagatgtacaataccctgcataggcacattccgcagggcaacgtcgatccagataggcatgatttcccaccttcataccaagaggccaataattctactgcaacaggtgctgcgggctcgagcgctgatctctcacatcaatcattgtccactgacgcattgggtgccacacgttcttcgtcaacatcaaatttagaaaacttaattccccttcgaaccgaacatcacagtattgcagcacatcaatcaaccgctgtcgatgaagattcactggatatacctcccatacttgatgacttgaacgatacagacaacattttcatcgacaaattgtacactttaccaaaaatgtccacacccatcgaaatcaccatcaagacgacgaagcatgcacctataccacacgtgaagccggaggaggagtccattttgaaagagtatacgtcgggggatttgattcatggttttatcactattgaaaacaaatctcaagcaaacctaaagtttgaaatgttctatgtcactttagagtcttacatttccattattgataaagtaaagagtaaaagaacgattaaacggtttttaaggatggtagacttgagcgcttcttggtcatactcgaaaatagcactggggtccggtgtggacttcattcccgcagatgttgactacgatggttctgtatttgggctaaacaatagccgggttctggaacccggagtcaagtacaagaaattcttcattttcaaattgccactgcaattgctagatgtcacttgtaagcaggagcatttctctcattgtttgttacctcccagttttggtattgataaatataggaacaattgcaaatattccggtatcaaagtcaatagggtacttgggtgcggtcatttaggtacaaagggctcccccatcttaactaacgatatgtctgatgacaacctttcgatcaattacactattgatgcaaggattgtcggtaaagatcaaaaggcctctaaactgtatattatgaaggaaagagaatataatctaagagtaatcccttttggttttgacgccaatgtcgtcggagaaagaaccactatgagtcagctgaatgatatcaccaaactagtgcaggaaaggttggatgctcttagaaaaatctttcagagattagagaaaaaagaacccataacgaaccgcgacattcacggtgcagacttgagtggtaccattgatgattctattgaatcagactcccaagaaattttgcagaggaaattggaccaactgcacattaagaacagaaataactatttagtcaactataacgatttgaagttgggccacgatttggacaatggccgcagtggaaatagtggtcataataccgatacttccagagcttggggtccctttgttgaaagtgaactaaaatataaactgaaaaacaaatccaattcctcctcatttctgaacttctctcattttttaaacagcagttccagctcaatgtcctcttcctcaaatgcgggaaagaataatcatgatttaacgggaaataaagaaaggacagggctaatactagtaaaggcgaaaattccaaaacagggcctaccatattgggctccctcattattgagaaagaccaatgtttttgaatctaagagtaaacacgaccaagaaaattgggtgagattgtctgagttgattccggaagacgtaaaaaaaccattggaaaaacttgatttacaattgacttgcatagaatccgataatagcttacctcatgatccgccagaaattcaatcgattaccacagaactgatatgtataactgctaaatctgataattctatcccaataaaactcaattctgaactgttgatgaacaaagagaagctgacaagcatcaaagctttgtacgatgatttccattcaaaaatttgtgaatatgaaaccaagttcaacaagaattttcttgaattaaatgagttatataatatgaataggggagaccgtaggccaaaggaactgaaatttacagattttattacttcacagctgtttaacgatatcgaaagcatttgcaacttgaaagttagtgttcacaacttatccaacatttttaaaaaacaggtcagtaccctaaaacaacactcaaagcacgcattatctgaggattcaatatcgcacacaggtaacggtagttcatcgtcgcccagttcagcgtcattaacgccagtaacttcttcatccaagagtagtttatttttacctagcggtagctcgtctacttccctgaaatttacagaccagattgttcataaatgggttaggattgctcctttacagtacaaacgagacattaatgtgaacttggaatttaataaggacattaaggaaactttaattccaagttttgaaagctgcctatgttgtaggttttattgcgttcgagtaatgattaaatttgaaaaccatcttggcgtagcgaagattgatatccctatttctgttaggcaagtgacaaaataa

SEQ ID NO: 46 - protein, 976 aa, Saccharomyces cerevisiae
MAKDLNDSGFPPKRKPLLRPQRSDFTANSSTTMNVNANTRGRGRQKQEGGKGSSRSPSLHSPKSWIRSASATGILGLRRPELAHSHSHAPSTGTPAGGNRSPLRRSTANATPVETGRSLTDGDINNVVDVLPSFEMYNTLHRHIPQGNVDPDRHDFPPSYQEANNSTATGAAGSSADLSHQSLSTDALGATRSSSTSNLENLIPLRTEHHSIAAHQSTAVDEDSLDIPPILDDLNDTDNIFIDKLYTLPKMSTPIEITIKTTKHAPIPHVKPEEESILKEYTSGDLIHGFITIENKSQANLKFEMFYVTLESYISIIDKVKSKRTIKRFLRMVDLSASWSYSKIALGSGVDFIPADVDYDGSVFGLNNSRVLEPGVKYKKFFIFKLPLQLLDVTCKQEHFSHCLLPPSFGIDKYRNNCKYSGIKVNRVLGCGHLGTKGSPILTNDMSDDNLSINYTIDARIVGKDQKASKLYIMKEREYNLRVIPFGFDANVVGERTTMSQLNDITKLVQERLDALRKIFQRLEKKEPITNRDIHGADLSGTIDDSIESDSQEILQRKLDQLHIKNRNNYLVNYNDLKLGHDLDNGRSGNSGHNTDTSRAWGPFVESELKYKLKNKSNSSSFLNFSHFLNSSSSSMSSSSNAGKNNHDLTGNKERTGLILVKAKIPKQGLPYWAPSLLRKTNVFESKSKHDQENWVRLSELIPEDVKKPLEKLDLQLTCIESDNSLPHDPPEIQSITTELICITAKSDNSIPIKLNSELLMNKEKLTSIKALYDDFHSKICEYETKFNKNFLELNELYNMNRGDRRPKELKFTDFITSQLFNDIESICNLKVSVHNLSNIFKKQVSTLKQHSKHALSEDSISHTGNGSSSSPSSASLTPVTSSSKSSLFLPSGSSSTSLKFTDQIVHKWVRIAPLQYKRDINVNLEFNKDIKETLIPSFESCLCCRFYCVRVMIKFENHLGVAKIDIPISVRQVTK

SEQ ID NO: 47 - DNA, 2763 bp, Saccharomyces cerevisiae
atgacttttacattctccacttcatcaaggaaaaatgggagacctcctttaaaatcagtttctacggaagataacattcatctattgaggaagcggcgtcaacagcagctgtcaagtaattctacagataattcgctgcatccaaatagtgggcagactccacgtgcaagtgacagccaggacgatgacatacgcagcgcttcaacaaccaatttagaccgtttacgacaagaacgagaggaaaattcactggaaatggactgcacacagtcaagattatctcatagagcaaatatgctagtggatgtcctaccatcttttgagatgtataatgccttgcacagacacatacctcaaggaaacgttgatcccgatagacatgatttccccccttcttatcaagaagttcgcactcaaagaatgactatattgcccagcaatgataattccgtggaaaggtcacaattgacagcagtgccaggatccgaaaacgcatgtaataatgcgactgcccattctcttaccaacctacatcctctacaaacacaacatcttacaataaacagtacaagaagtggtggacagtcgctccattcttcatcagacaccaatatcagtcaaataccgttcgaagatgatctaaacgactcggataacatttttatagacaagttatacaccttacccaagttatccactcctatcgaaattgatataagaataacgaaaactgcatcaatacctcatgagcgtcctgaggaacagtcaatattgaaggaatacacctcgggtgatattattcatggttattgtttaattgaaaatcggtcctctcaaccactgaaatttgaaatgttttatgtcactttagaagcgtacatatctgtaattgaccgtcagaaagggaaaagaacgttaaagagatttttaagaatggtcgatttgagcgcatcttggtcttatacaaacataaccccaagtacgggtattaatattgtccccggtgaaagggattttgacgatgccatcattggtctttcaaacagcagagaattgaagccgaacacaaagtataagaaattcttcatgttcaagcttcctacacagttattggacgtgacttgcaaacaagagcaattctcacactgccttctgcctcccagctttggtatcgacaagtataaaaataattgtaaatactctggcataaaagtaaatagtgtccttggctgtgggcatttaggtacaaaaggttcacccattctgacacttgacatggcagatgataatttatcaataaattatacaattgatgccaaaattgtcggtaaagataaaagaacatctaagctgaatattatgaaagaaaaagaatataacttgagagttatgcccttcccctttgctggtgtcactaatcaacaaaacgagaaaacgtgtttgagacaactgaaaaatttggaaagcttgattgaagatagatttgaagctttgaacaagattttcaagaaactggaattaaatgaggccatttcgaatgtagatattcatgacacagatataagcgggactttggacggtaatgaagatttggattccgatgagatattaagacgtaagctagatcaactgcacatcaataacaggattgatgataccgccagccaatcaccatcctatgactccaaaaatatggctccaaaggaaaacctagtcgagactgagttacgctataagtttaaaaataagaataaatcaaattcaagtttattttctcattttttgagttcatcagaaacggggtcatcttcaactggtccacatgtatataattccggattgattgtattatcagttaaaaaaccgcaatctacattaccttattggtcaccatcattgttgagaaaaaccaacaaatttgaagcaaagagtgaacaagaaaaggaaaactggcaaaggttaatgggcatgcttccagaaggagtgaaaaccccactgaccaagttagatgtacatttgacttgtatccaatctaataatagtgcaggacataagccgccagaaataagctctgtaacgacagaatttgtggtcatcacagcaaagtctgataattcgattcctatcaaattctgcactgaactgttgatgaatgagaatagattaaacaaactaaagacaaaatttttgacgtatcagaaaaaagttcatgaatatcgtaaaaaatttgaagaaaaccatgcgaagctaaacgagctttataatagaaatagagatcatttcactccaaaagagcttttgttcacaaatttcatatctgatcaaataaacaatgatattgacagtttagctggattaaaagttaacattattgatttacatgatatcttcaaaaagcaaatacatacttttgaagaagaaaacgaggatattatttcgaagaaaggaagttccaatcctccttccgcgtcatccagtaataataatttcttacaagcaacatttagcaatggtgcatccaccgctactaagtttactcagcaaattgtgcatgaatgggaaaaagttaagccattacagtataagagggatgttacagttaatttgaagctcaaccccaacattaaagaaacgttagtgcccaatcttgaaacgtgtttgtgttgtagattttattgtgttcgagtaaacatcaaatttgataaccacttgggttctatgaaagttgatattccggttgatgtgaaaaagttacaaatttag

SEQ ID NO: 48 - protein, 920 aa, Saccharomyces cerevisiae
MTFTFSTSSRKNGRPPLKSVSTEDNIHLLRKRRQQQLSSNSTDNSLHPNSGQTPRASDSQDDDIRSASTTNLDRLRQEREENSLEMDCTQSRLSHRANMLVDVLPSFEMYNALHRHIPQGNVDPDRHDFPPSYQEVRTQRMTILPSNDNSVERSQLTAVPGSENACNNATAHSLTNLHPLQTQHLTINSTRSGGQSLHSSSDTNISQIPFEDDLNDSDNIFIDKLYTLPKLSTPIEIDIRITKTASIPHERPEEQSILKEYTSGDIIHGYCLIENRSSQPLKFEMFYVTLEAYISVIDRQKGKRTLKRFLRMVDLSASWSYTNITPSTGINIVPGERDFDDAIIGLSNSRELKPNTKYKKFFMFKLPTQLLDVTCKQEQFSHCLLPPSFGIDKYKNNCKYSGIKVNSVLGCGHLGTKGSPILTLDMADDNLSINYTIDAKIVGKDKRTSKLNIMKEKEYNLRVMPFPFAGVTNQQNEKTCLRQLKNLESLIEDRFEALNKIFKKLELNEAISNVDIHDTDISGTLDGNEDLDSDEILRRKLDQLHINNRIDDTASQSPSYDSKNMAPKENLVETELRYKFKNKNKSNSSLFSHFLSSSETGSSSTGPHVYNSGLIVLSVKKPQSTLPYWSPSLLRKTNKFEAKSEQEKENWQRLMGMLPEGVKTPLTKLDVHLTCIQSNNSAGHKPPEISSVTTEFVVITAKSDNSIPIKFCTELLMNENRLNKLKTKFLTYQKKVHEYRKKFEENHAKLNELYNRNRDHFTPKELLFTNFISDQINNDIDSLAGLKVNIIDLHDIFKKQIHTFEEENEDIISKKGSSNPPSASSSNNNFLQATFSNGASTATKFTQQIVHEWEKVKPLQYKRDVTVNLKLNPNIKETLVPNLETCLCCRFYCVRVNIKFDNHLGSMKVDIPVDVKKLQI

SEQ ID NO: 49 - DNA, 2070 bp, Saccharomyces cerevisiae
atgcaagcccaaggttcacaatcgaatgtagggtctttgaggagtaattgctctgacaattcactaccgaacaatcatgttatgatgcactgcgatgaaagcagcggcagcccgcacagcgagcacaacgattatagttacgaaaagaccaatctggaaagtacggcatcaaatagtcgtgaacacagagacaaccagctaagtaggttgaagagtgaggaatacgttgttccaaagaatcaacgtaggggactattgcctcaactcgccattataccggagttcaaggatgccagagattatccaccgatgatgaaaaagatgattgtcttcttgattgcgttttcctccatgatgggccccatgggcacatctatcatttttccagcgatcaactcaatcacaacagaatttaaaacatcagtgattatggtaaacgtttcaattggtgtgtaccttttaagtcttggtgttttcccattgtggtggtcttctctatccgagctagagggcagaagaactacttacataacttcatttgcattattgtttgcatttaatatcgggtctgctctagctcctgatatcaactcatttattgccttgagaatgctctgtggggctgcttctgccagtgttcaaagtgtaggtgctggaacagtggctgatttatatattagcgaagatagaggtaaaaatttgagttattactatttgggtccactactggcgccgctactatctccaatttttggatctttgttagtgaatcgctggccctggagatccactcaatggtttatggttattttatccggatgtaatgtcattcttttgacggtgttactacctgaaacattaagaaaacaagattctaaaggcgctatcgctcaaattttggctgaaagacgtattcaagtagacaataacgaacgtggagagatacaagaagattatcagaggggagaagatgagacagatcgaattgaaaaccaagttgccacattatctactgagaagcataactacgttggagaggtaagggatcaagactcgctagatttagaaagtcactctagccccaatacttatgatggtcgagctggagaaacccaattgcaacggatttatacagaggcgagtagaagtctgtatgaatatcagctagatgatagcggtatcgatgcaacaacagcacaagttacgagaataagatcaacagatccaaagttagcgagatcgattcgagaaaatagtctgagaaaattacaaaccaacctggaagagcaagtcaaaaaagtgctatccagtaatggaggtgaaatcgctcctaaacaggtatcagcggtgaggaaggtctgggacaccttttttgtttattttatcaagcctttaaaatcattgcacttcctagaatatccacccgtggcacttgcaataacattttccgcaatttccttttccacagtatactttgttaatatgacagttgaatataaatattcaaggcctccttacaactttaaaccattatacattggtctactgtatattccgaattctgtaacatactttttcgcctcaatttacggtggacgttgggtggacatgcttttaaaaagatacaaagagaaatatggaattcttgctcctgaagctcgtatatcgtggaatgttgttacatctgtaatatctttccccattgcgctattgatatttggctggtgcctagataaaaaatgccactgggtaacgccactaattggaacagccctctttggatatgcagctatgatgacaattggtgctaccctttcctatttagtcgattcattgccgggaaagggtgccaccggtgttgctttgaataatttaataaggcaaatcttggctgcaaccgcagtctttgtcaccacacccatgttaaacggtatgggaactgggtgggctttcacaatgctggcctttatcgtcttgggtgctagcagtgtacttataatactgaaaaagcacggtgattactggagagagaactacgatttacaaaaattgtacgacaaaattgattaa

SEQ ID NO: 50 - protein, 689 aa, Saccharomyces cerevisiae
MQAQGSQSNVGSLRSNCSDNSLPNNHVMMHCDESSGSPHSEHNDYSYEKTNLESTASNSREHRDNQLSRLKSEEYVVPKNQRRGLLPQLAIIPEFKDARDYPPMMKKMIVFLIAFSSMMGPMGTSIIFPAINSITTEFKTSVIMVNVSIGVYLLSLGVFPLWWSSLSELEGRRTTYITSFALLFAFNIGSALAPDINSFIALRMLCGAASASVQSVGAGTVADLYISEDRGKNLSYYYLGPLLAPLLSPIFGSLLVNRWPWRSTQWFMVILSGCNVILLTVLLPETLRKQDSKGAIAQILAERRIQVDNNERGEIQEDYQRGEDETDRIENQVATLSTEKHNYVGEVRDQDSLDLESHSSPNTYDGRAGETQLQRIYTEASRSLYEYQLDDSGIDATTAQVTRIRSTDPKLARSIRENSLRKLQTNLEEQVKKVLSSNGGEIAPKQVSAVRKVWDTFFVYFIKPLKSLHFLEYPPVALAITFSAISFSTVYFVNMTVEYKYSRPPYNFKPLYIGLLYIPNSVTYFFASIYGGRWVDMLLKRYKEKYGILAPEARISWNVVTSVISFPIALLIFGWCLDKKCHWVTPLIGTALFGYAAMMTIGATLSYLVDSLPGKGATGVALNNLIRQILAATAVFVTTPMLNGMGTGWAFTMLAFIVLGASSVLIILKKHGDYWRENYDLQKLYDKID

SEQ ID NO: 51 - DNA, 483 bp, Saccharomyces cerevisiae
atgactgaattgtgtcctgtctacgcccctttctttggtgccattggttgtgcctctgcaattatcttcacctcattaggtgctgcttacggtactgctaagtctggtgttggtatctgtgccacttgtgtgttgagaccagacctattattcaagaacattgttcctgttattatggctggtatcattgccatttacggtttagttgtttccgttttggtttgttattcgttgggtcaaaagcaagctttgtacaccggtttcatccaattgggtgccggtctatcagtcggtttgagtggtctagctgctggtttcgctattggtattgtcggtgatgcaggtgttagaggttcctctcaacaaccaagattattcgtcggtatgattttgattttgatttttgctgaagttttgggtctatacggtttgattgttgctttgttgttgaactccagggctactcaagatgttgtctgttaa

SEQ ID NO: 52 - protein, 160 aa, Saccharomyces cerevisiae
MTELCPVYAPFFGAIGCASAIIFTSLGAAYGTAKSGVGICATCVLRPDLLFKNIVPVIMAGIIAIYGLVVSVLVCYSLGQKQALYTGFIQLGAGLSVGLSGLAAGFAIGIVGDAGVRGSSQQPRLFVGMILILIFAEVLGLYGLIVALLLNSRATQDVVC

SEQ ID NO: 53 - DNA, 2076 bp, Saccharomyces cerevisiae
atgacaaggttcatgaacagctttgccaaacaaacgctgggatatggcaatatggcgacagtggagcaagagagctcagctcaggctgttgattctcattcaaacaacacaccgaagcaagctaagggtgttcttgcagaggaactaaaggatgcattgcggttccgggacgaaagagttagtattattaatgcagagccttcttcaacactgttcgtcttttggtttgtggtttcatgctatttccctgtgattactgcctgcttgggtcccgtagctaacactatctcgatagcctgtgtagttgaaaaatggagatccttaaagaacaactccgtggtgacaaatccacgaagcaatgacaccgatgttttgatgaatcaagtaaagacagtttttgatcctcctggtatttttgccgttaatatcatctctttggtactgggttttacgtcaaatattatactaatgctacatttcagtaagaagttgacgtatcttaaatctcagttaataaatataacaggatggacaatagctggagggatgcttttggtggacgtgattgtatgctccttgaatgacatgcccagcatctacagtaagactatcggattttggtttgcctgtatcagttctggtctatatttggtatgcaccattattttaacaatacattttattggatataaattaggaaaatatcctccaacgttcaaccttttgcccaatgaaagaagtatcatggcatacactgtactattgtctttatggttgatttggggtgcgggtatgtttagcggtttattgcacatcacttacggaaatgcattatatttctgcacggtatcattattaaccgtgggactaggtgacatcctgcccaagtcggttggcgccaaaatcatggttttaatcttttcgctatctggtgttgtcttgatgggtttaatagtgtttatgacaagatccatcattcaaaagtcctctggcccaattttctttttccacagagttgaaaaaggcaggtccaaatcgtggaaacattatatggatagtagtaaaaatttatctgaaagggaagcgttcgacttaatgaagtgtatccgacaaacggcctcaaggaagcagcattggttttctttgtcggtgactattgcaattttcatggctttttggttattgggagctcttgtattcaaattcgcagaaaattggtcgtacttcaattgtatttacttttgtttcttgtgcttattaaccattggatacggagactatgctccaaggactggtgcaggccgtgctttttttgtgatttgggcgttgggagccgtgccattaatgggggctatcctatctacagtcggtgatctgttgtttgacatttccacttctctggatattaagatcggtgaatcattcaataataaagtcaagtccatcgtttttaatgggcgtcaaagagcactttcctttatggtgaacactggagaaattttcgaagaatctgacacagctgatggtgatctggaagaaaatacaacgagctcacaatccagtcaaatttctgaattcaacgataataattcagaagagaatgattctggagtgacatcccctcctgcaagcctgcaagaatcattttcttcattatcaaaagcatctagcccagagggaatacttcctctagaatatgtttcttctgctgaatatgcactacaggactcggggacctgtaatttaaggaacttgcaagagctacttaaagccgtcaaaaaactacatcggatatgtctggcggataaagattacacacttagtttttccgactggtcgtacattcataaactacatttgaggaacattacagatattgaggagtacacacgcggacccgaattttggatatcacctgatacgcccctcaagttcccgttaaatgaacctcattttgcttttatgatgcttttcaagaacatagaagaattagttggtaatctagtagaagacgaagagctttataaagttataagcaaaagaaaatttttgggtgagcatagaaagacactttga

SEQ ID NO: 54 - protein, 691 aa, Saccharomyces cerevisiae
MTRFMNSFAKQTLGYGNMATVEQESSAQAVDSHSNNTPKQAKGVLAEELKDALRFRDERVSIINAEPSSTLFVFWFVVSCYFPVITACLGPVANTISIACVVEKWRSLKNNSVVTNPRSNDTDVLMNQVKTVFDPPGIFAVNIISLVLGFTSNIILMLHFSKKLTYLKSQLINITGWTIAGGMLLVDVIVCSLNDMPSIYSKTIGFWFACISSGLYLVCTIILTIHFIGYKLGKYPPTFNLLPNERSIMAYTVLLSLWLIWGAGMFSGLLHITYGNALYFCTVSLLTVGLGDILPKSVGAKIMVLIFSLSGVVLMGLIVFMTRSIIQKSSGPIFFFHRVEKGRSKSWKHYMDSSKNLSEREAFDLMKCIRQTASRKQHWFSLSVTIAIFMAFWLLGALVFKFAENWSYFNCIYFCFLCLLTIGYGDYAPRTGAGRAFFVIWALGAVPLMGAILSTVGDLLFDISTSLDIKIGESFNNKVKSIVFNGRQRALSFMVNTGEIFEESDTADGDLEENTTSSQSSQISEFNDNNSEENDSGVTSPPASLQESFSSLSKASSPEGILPLEYVSSAEYALQDSGTCNLRNLQELLKAVKKLHRICLADKDYTLSFSDWSYIHKLHLRNITDIEEYTRGPEFWISPDTPLKFPLNEPHFAFMMLFKNIEELVGNLVEDEELYKVISKRKFLGEHRKTL

SEQ ID NO: 55 - DNA, 2178 bp, Saccharomyces cerevisiae
atggactgggcaatcaatgtcgcccatccacgattactttacaaggatcctaaactttcagtaacgtttattgtgccgagcttatttcatatcattattgctttcgtgttattaggaatatgtgcatccgattttctttgccccaacgtggcccatatatcagatcccaacagccttcgatcgaatggttctttagtctcaaaaacggcgtcccatgcatctcatactggggcattaatggcagttctactatcttggtgtaactcttcgcctgacctattttccaacttaatgagctgggcaacctctacgagagaaacaaggtcaacctcagtatcgctatcaattggtgaggtgcttggcgcttgcggcattatcctgtgcattgtagagggctccatttttattattatgtcaagaactcacattgaaatctcgcaaattcaaaaactatccatcatgagagacttgttattttctttagctgccatgtgcgtaatgagttacgtttcccttatgaatcaggtcactgtgctgaattgccttttgatggcgttcctttatgccttttatctagtcgttaagttaactttcaagcttaatcattctgcagaaaccccagatgaaactgctgcggatacgagcctcagagaaaactccgtttctccttttttggatgactctctgatggcttctggtttactaccaccaatacaacctggctttgacatatccaattctataacacacggcattaagcctagtttgctatctgctatggatttcaatagtttcttatcaatgcttgaaaactcatctttggaggaggatgactcaaggaatgaaatggcagaattgaacactctacgtagcatgacgccgggacaacattggtccgcctctgcaacagttgcaggagaggcaacgagtgctggaagacctttcagtgagccaacgaatgcgtttacggaatatagagattctgaaagagcaataaatagttccccagcggtgttcgccccctaccgtgacaaccctgatgatgaagagtctcaagagcaagtattattggagacaacaacgcatggtcattttggtgcgcaagaaatgcgaaggttctccaaaaggtctctgggctggattataaaaattttcataccacatctctcaaatttttcccagaaatccatctcagatgcgatcttttccataataactgttccgtttttcattattttcaaactatcatgtcctcaaccgccttcagatattttgagttatgatcccactttgaacagatactctttaacaacgttacccataattttattatttatccaatcaattactgcacccttcctcctttgcagtatactttctgtgcttttgacatatcatctaggctatctcgtttaccttttccctcttatattagctatggccttaattttactattgacggcttttattacaaaggtaaatctgcataacaagtttactctgtcattagacagctctaacattttacaggaaaagctacaaaaaagaaaactcctcgaaaggcttaacacaagcatccaaataatttttctagctatcggcataataaatatcataatttggatatcacttttagccaattctcttattgagatgatggaaatttaccaaaaaatattaggattatcgaaagctattttgggccttaccattttcgcatggggcaactcagtaggagacttgatctccaacatatctatgtgcaggctctacaaaacccaaactcactaccaagacagagttcgtttagccacaaaattttttatgatatcatgcgcatcttgcttaggaggcgtaatgctgaattctatgggtggaataggctttagtgggctagtatcaatgctttttattggcgcttttaatgataacgaatggtggttcctaagaaaggttaaattacaagaaacaagtcaattggataatacattaaattacaaattcatagtttcttgcgtcttcattatcctacagattattctcttgctgttattcttcggagggcctaacaatattaaacggcgcctcacaaaggagatgaagttagtcggaatctctatgtgcggactatgggcactagccacgttgattaatatacttctagaactgtttagctaa

SEQ ID NO: 56 - protein, 725 aa, Saccharomyces cerevisiae
MDWAINVAHPRLLYKDPKLSVTFIVPSLFHIIIAFVLLGICASDFLCPNVAHISDPNSLRSNGSLVSKTASHASHTGALMAVLLSWCNSSPDLFSNLMSWATSTRETRSTSVSLSIGEVLGACGIILCIVEGSIFIIMSRTHIEISQIQKLSIMRDLLFSLAAMCVMSYVSLMNQVTVLNCLLMAFLYAFYLVVKLTFKLNHSAETPDETAADTSLRENSVSPFLDDSLMASGLLPPIQPGFDISNSITHGIKPSLLSAMDFNSFLSMLENSSLEEDDSRNEMAELNTLRSMTPGQHWSASATVAGEATSAGRPFSEPTNAFTEYRDSERAINSSPAVFAPYRDNPDDEESQEQVLLETTTHGHFGAQEMRRFSKRSLGWIIKIFIPHLSNFSQKSISDAIFSIITVPFFIIFKLSCPQPPSDILSYDPTLNRYSLTTLPIILLFIQSITAPFLLCSILSVLLTYHLGYLVYLFPLILAMALILLLTAFITKVNLHNKFTLSLDSSNILQEKLQKRKLLERLNTSIQIIFLAIGIINIIIWISLLANSLIEMMEIYQKILGLSKAILGLTIFAWGNSVGDLISNISMCRLYKTQTHYQDRVRLATKFFMISCASCLGGVMLNSMGGIGFSGLVSMLFIGAFNDNEWWFLRKVKLQETSQLDNTLNYKFIVSCVFIILQIILLLLFFGGPNNIKRRLTKEMKLVGISMCGLWALATLINILLELFS

SEQ ID NO: 57 - DNA, 1107 bp, Saccharomyces cerevisiae
atgaactcatggaacctgagttcttcaataccgataatacatacgcctcatgaccatcccccgacatcagaaggaactccagatcaaccaaataataaccgaaaagatgataaactgcacaaaaaaagaggcgattcagatgaggacttaagccctatatggcattgtgtcgtctccggtgggattggtggaaaaataggagattctgcgatgcattcattggatactgttaagacaagacaacagggcgcacccaatgtcaaaaaatacaggaacatgatctctgcatatcgtaccatttggctagaagaaggcgtgagaagggggctatacggcggttacatggctgccatgttaggctccttcccgtcagcggcaatcttctttgggacctatgaatatactaagagaacaatgatagaagattggcagattaacgataccatcacacatttgagcgctggatttcttggcgattttatctccagttttgtttatgttccatcagaggtcctaaagacaaggctacaattgcaaggaaggttcaataatcctttctttcaatctggctataattattcgaatttaagaaatgccataaagacagttataaaagaagaagggtttcgctcactattttttggatacaaagccactttagccagagatttgccatttagtgcattgcagtttgccttctacgaaaagtttaggcaattggctttcaagattgaacagaaagatggtagggatggtgagttgtctatacctaatgaaatattgactggtgcctgtgcaggtggactggcgggaatcattaccacaccaatggatgttgttaagactagagtccaaactcaacagccgcccagccaaagcaacaaatcatactcagtaacacatccacatgtaacaaacggcagaccggcagcactttccaactcgatttcgctcagccttcggacggtctaccaatctgaaggtgtgttaggtttctttagtggcgttggccctagattcgtctggacaagtgttcagagcagtataatgttgcttctgtatcaaatgaccctacgcggattaagtaacgcatttccaacggactaa

SEQ ID NO: 58 - protein, 368 aa, Saccharomyces cerevisiae
MNSWNLSSSIPIIHTPHDHPPTSEGTPDQPNNNRKDDKLHKKRGDSDEDLSPIWHCVVSGGIGGKIGDSAMHSLDTVKTRQQGAPNVKKYRNMISAYRTIWLEEGVRRGLYGGYMAAMLGSFPSAAIFFGTYEYTKRTMIEDWQINDTITHLSAGFLGDFISSFVYVPSEVLKTRLQLQGRFNNPFFQSGYNYSNLRNAIKTVIKEEGFRSLFFGYKATLARDLPFSALQFAFYEKFRQLAFKIEQKDGRDGELSIPNEILTGACAGGLAGIITTPMDVVKTRVQTQQPPSQSNKSYSVTHPHVTNGRPAALSNSISLSLRTVYQSEGVLGFFSGVGPRFVWTSVQSSIMLLLYQMTLRGLSNAFPTD

SEQ ID NO: 59 - DNA, 1629 bp, Saccharomyces cerevisiae
atgtccgtacaaaaagaagaatacgatattgtagaaaaggcccaattatctgtgtccgcagaaagcttaacatcagattcggagagtatttcacataacccatttgacgattttcataaagcagagcgttggagaaaagtctatgaatccagtggttatgaaggcttgtctaaattcgatcctgagtttacatggacaaaggatgaggaaaagaaattggtaagaaaaatggacttgaagatttttttgtgggtttttattatgtttgcctttttggatttaataaggaaaaatattgcaagggcagtttcagacaacttcattgttgacttgaaaatgaacacgaacgactacaaccttggccaaactgtttatctagttatatttctagcaagtgaactacccggcaatctgctgtccaaaagatttggtccagaaagggtcattccggttcaaattgtgttgtggagtgtaatttgtattactcaagctggtctgaaaaatcgaggtcaatttattgctactagatgcttattaggaatggtacagggcgggttcatcccggacaatattctatacttgtcatattattatactggagctgagctcacattccgcctaagtttcttttggtgtgctatacctcttttccaaattttaggctctcttttagcttccggaatcatagagatgaggggtattcataacttagctggctggcagtacctatttataattgaagggtttctgtccctttctgttggcgtggcatccttttatttaatgcgtagaggacctacgcaaactggtgagtctgcatttcacaaaggaaaatcgttattcactgagtatgaggagaaaattatggttaacagaattttaagggatgacccatcaaagggtgacatgagtaaccgacaaccagttaccttcaaggagattttgtacactctaacagaatttgatctatggccattgtttatccaaggtattacagcattcatatctcttcaaacagttggttcctatttatctttgatattaaagagtttaaattactctacatttctttcgaacattttagcaattccaggccaagccctgctgctaataaatttaccattagcggcactattatcgcgtaaattgaaagaaaaatcactttgtgtgggaattgccaacgtttgggtgctccctttcatagtttctctggtcgctttaccgactgacacaaacccctggatcaagtatatattactaaccggtatacttggtcttccctatacacattccattcttgctggttgggtctccgagatttcaaattcggtaagatcgcgtacagtgggcacagcgttatacaatatgagtgcccaagttggagcaatcattgcttctaacatgtatagaaatgatgataaaccttactatactagaggtaacaaaatacttctaggattcacttgcttcaacatttgtatggctgttgctactaagttttactatattagtaggaataaatacaaggaccgcaaatggaactctatgacaaaagaagagcagatcaattacttggacacaactaaagataagggaatgaagcgtcttgattataggtttattcactag

SEQ ID NO: 60 - protein, 542 aa, Saccharomyces cerevisiae
MSVQKEEYDIVEKAQLSVSAESLTSDSESISHNPFDDFHKAERWRKVYESSGYEGLSKFDPEFTWTKDEEKKLVRKMDLKIFLWVFIMFAFLDLIRKNIARAVSDNFIVDLKMNTNDYNLGQTVYLVIFLASELPGNLLSKRFGPERVIPVQIVLWSVICITQAGLKNRGQFIATRCLLGMVQGGFIPDNILYLSYYYTGAELTFRLSFFWCAIPLFQILGSLLASGIIEMRGIHNLAGWQYLFIIEGFLSLSVGVASFYLMRRGPTQTGESAFHKGKSLFTEYEEKIMVNRILRDDPSKGDMSNRQPVTFKEILYTLTEFDLWPLFIQGITAFISLQTVGSYLSLILKSLNYSTFLSNILAIPGQALLLINLPLAALLSRKLKEKSLCVGIANVWVLPFIVSLVALPTDTNPWIKYILLTGILGLPYTHSILAGWVSEISNSVRSRTVGTALYNMSAQVGAIIASNMYRNDDKPYYTRGNKILLGFTCFNICMAVATKFYYISRNKYKDRKWNSMTKEEQINYLDTTKDKGMKRLDYRFIH

SEQ ID NO: 61 - DNA, 975 bp, Saccharomyces cerevisiae
atgtcatctgacaactctaaacaagataaacaaattgaaaaaacagccgcccagaagatatcgaagtttggttcgtttgtggctggtgggctagcagcatgtatagctgttacagttactaatccgatcgaattgattaaaatcagaatgcagcttcaaggtgaaatgtcagcatcagctgcaaaagtttataaaaatccaatccaaggtatggcggtaattttcaaaaacgaaggtataaaaggtctgcaaaaagggttaaatgctgcttatatctatcaaattgggctaaatggttccagattagggttttatgagccaatcagatcatcattaaatcagcttttcttcccagatcaagagccacataaggtacagagcgtcggagttaacgtcttttctggtgccgcatctggtataattggtgcagtcattggctctccattattcttggtgaaaacaagacttcaatcatattccgagtttataaaaattggtgaacaaacgcactacaccggtgtttggaacgggttagtaaccatttttaaaaccgaaggtgttaagggtctattcagaggtattgatgcggcaattttaaggacaggtgctggttcctctgttcaactacctatctacaacacagcaaagaacattttggtcaaaaatgatctgatgaaagatggcccagcattacatttaactgctagtactatctctgggttaggtgttgccgtcgttatgaacccatgggatgtcattttgacaagaatctataatcaaaaaggtgacttgtacaagggacctatagattgtttggtcaaaactgttagaatcgaaggtgtaaccgctttgtataagggttttgcagctcaagtgttcagaatcgcacctcatacaatcatgtgtttgaccttcatggaacagacaatgaaactagtttattcgatagagtcgagagttttaggccataattaa

SEQ ID NO: 62 - protein, 324 aa, Saccharomyces cerevisiae
MSSDNSKQDKQIEKTAAQKISKFGSFVAGGLAACIAVTVTNPIELIKIRMQLQGEMSASAAKVYKNPIQGMAVIFKNEGIKGLQKGLNAAYIYQIGLNGSRLGFYEPIRSSLNQLFFPDQEPHKVQSVGVNVFSGAASGIIGAVIGSPLFLVKTRLQSYSEFIKIGEQTHYTGVWNGLVTIFKTEGVKGLFRGIDAAILRTGAGSSVQLPIYNTAKNILVKNDLMKDGPALHLTASTISGLGVAVVMNPWDVILTRIYNQKGDLYKGPIDCLVKTVRIEGVTALYKGFAAQVFRIAPHTIMCLTFMEQTMKLVYSIESRVLGHN

SEQ ID NO: 63 - DNA, 1830 bp, Saccharomyces cerevisiae
atgctatcttcagaagattttggatcttctgggaaaaaggaaacttctcctgattcgatatcgatacgttcctttagtgccgggaataatttccaatcatcatcaagtgagaaaacttattctaagcaaaaatccgggagtgacaaacttatacatagatttgcggattcattcaaaagagccgagggtagcactacaagaactaagcaaataaatgaaaatacgtctgatttagaggatggcgttgagtctatcacgtcggattccaagttgaaaaagtccatgaagtcgcgccatgttgtcatgatgtctttagggacaggtattgggactggtcttttggtagctaatgcaaaaggtctacattacggtggtcctgctgcgctaataattggttacatcttggtttctttcgtgacgtacttcatgatccaagctgcaggtgagatggcggtaacctatccgactttaccagcaaatttcaacgcatactcctccatattcatttccaaatcatttggattcgccacagtatggctttactgtttccaatggctaacggttttgcctttagagttaataaccgcgtctatgactattcaattttggaatgataaaataaatccggacatttatattcttattttctatgttttcttagtattcattcatttcttcggtgtaaaagcctatggtgaaacggaattcatcttcaattgctgtaaaattttaatgattgcaggtttcattattctttctattgttatcaactgtggtggggccggaaatgacggttatatcggggccacttattggcataatccaggtgcttttgcaggtgacacatcgattggtaggttcaaaaacgtttgctatattttagttactgcttacttctcctttggtggtatggaattatttgcactaagtgttcaggaacagtctaaccctagaaaatctactccggtggcagccaagagaagcatttatcgtatcgttgtgatttatcttttgactatgatcctcattggattcaatgttccatataatgatgaccaactaatgggcgcaggcggatccgctacacatgcatctccctatgtcttagccgcttctattcacggtgtgaaaattgttccacatattatcaacgctgttattttgatttctgtggtttcagtggcaaattcctctttgtatgctggtccaagactgatttgctctttggcccaacaaggctacgcacccaagtttttagattacgttgacagagagggcaggcccttgagagctcttattgtgtgttgcgttttcggcgtcattgcttttgttgcagcttcatcaaaggaagagatcgtgtttacatggttagcagctatcgcaggcttgagtgaattattcacatggacttccataatgttgtcccatctgcgattcagacaagcaatgaaagtacagggaaggtctctagacgagttgggatacaaggccacaacagggatttggggttccatatacggtgtcttttttaatattttagtctttgttgcccaattttgggtagcattggcccccttaggtaatgggggcaaatgcgatgcggaatccttctttcaaaattatttagcttttccaatatggttggccttttacttcggatatatggtttacaaccgtgattttacgctattaaatcccctcgacaagattgaccttgacttccacagacgcatttatgatccagagctaatgagacaagaggacgaagaaaataaagaaaaactaaggaatatgtctttgatgagaaaagcttatcatttctggtgttaa

SEQ ID NO: 64 - protein, 609 aa, Saccharomyces cerevisiae
MLSSEDFGSSGKKETSPDSISIRSFSAGNNFQSSSSEKTYSKQKSGSDKLIHRFADSFKRAEGSTTRTKQINENTSDLEDGVESITSDSKLKKSMKSRHVVMMSLGTGIGTGLLVANAKGLHYGGPAALIIGYILVSFVTYFMIQAAGEMAVTYPTLPANFNAYSSIFISKSFGFATVWLYCFQWLTVLPLELITASMTIQFWNDKINPDIYILIFYVFLVFIHFFGVKAYGETEFIFNCCKILMIAGFIILSIVINCGGAGNDGYIGATYWHNPGAFAGDTSIGRFKNVCYILVTAYFSFGGMELFALSVQEQSNPRKSTPVAAKRSIYRIVVIYLLTMILIGFNVPYNDDQLMGAGGSATHASPYVLAASIHGVKIVPHIINAVILISVVSVANSSLYAGPRLICSLAQQGYAPKFLDYVDREGRPLRALIVCCVFGVIAFVAASSKEEIVFTWLAAIAGLSELFTWTSIMLSHLRFRQAMKVQGRSLDELGYKATTGIWGSIYGVFFNILVFVAQFWVALAPLGNGGKCDAESFFQNYLAFPIWLAFYFGYMVYNRDFTLLNPLDKIDLDFHRRIYDPELMRQEDEENKEKLRNMSLMRKAYHFWC

SEQ ID NO: 65 - DNA, 1683 bp, Saccharomyces cerevisiae
atggaacctaagcgaaagagcgggtcactagccaagcatgatttgccgcaattttatcttttaattatgttatatttggctcaaggcatacctgtaggattggccttcggtaccgtaccgtttctactgaaatctttagcaaaggagacctcgtttacatcactgggaattttctctatggctacatatccatattctttaaagatcatatggtcaccaatagtagactcactgtacaacaagcgcatcggtagaagaagatcatggatcattccagtacaatttgttagtggatttgtgctatgggcattagggtggtgcatatcacaaggcataatcttcgatggtgtcgacgatgcgttccataatcgcggtaatggcactttacacagtgtcagtataaaaaatttgacgtggtggtttggcctgttagtttttctgtgtgccactcaagacatcgcagttgatggttgggcgttgacgattttgtccaaagaatccctatcatatgcatctaccgcgcaaacaataggtttgaatattggttattttatgtcatttaccattttcctgtcgttgaattcctctgatttcgccaataagtatttcagaaacatcccactggatcacgggttcattagtcttggtgggtacatgaaattctcgggcatgctttacattgtaataaccatatatatcatcttttgcaccaaggaaaaaccctacgtagagtatttgcccaaagtggagcccataaatacaagtgacggagggtcaaagccgataagtattgagtatgacgacggtgatgtggtgtcaactcagaatacaagcagtataaagtacatttaccgctgctttataaaagtgttgaaattgaagtccgtaagaagcctagccttcattcacatgatttcgaaatttgcctttcaatgcaacgaagccgccacaaacctgaaactactagagcaaggcttcaaaagagaagacttggctgtgacagtactcatagacctgccgttcgaaatcatatttgggtactatgttgttaaatggagctccgacaaggaccccatgattcgtgacaatagaagattaagaaacagcacgggcaccaacaaggtcatcaagttcttagttggggatgccggcgttttaacaccatggttgtggggctttttgggccgtctggcagccgcggtcttgggaagttacgtggtgaagcaattccccaaggatggtgaaatatccacgggttatttttgtctcgtgatattccagcacctcttaggttccttcatgaatactgtccagttcattggaatatcggccttccatacaagagttgcagaccccgtgctgggtggcacatatatgacattgttaaataccctcagcaacttcggtgggacatggccgcggttaatcattatgtccatgatcaactacttcaccgtgtatcagtgcactattcctggcacaaataaagtatacgtaactcacggcggcagcatgcaagcgtgcaccgagcttttgaatggcaccgtgaccatcctgcgtgacggctattacatcaccaatctcatatgtattgtagtcggacttttcctatattttggatatttgaaaaggaaaatcctccatttacaaagtctgccaatcagttcctggagatgtacgtaa

SEQ ID NO: 66 - protein, 560 aa, Saccharomyces cerevisiae
MEPKRKSGSLAKHDLPQFYLLIMLYLAQGIPVGLAFGTVPFLLKSLAKETSFTSLGIFSMATYPYSLKIIWSPIVDSLYNKRIGRRRSWIIPVQFVSGFVLWALGWCISQGIIFDGVDDAFHNRGNGTLHSVSIKNLTWWFGLLVFLCATQDIAVDGWALTILSKESLSYASTAQTIGLNIGYFMSFTIFLSLNSSDFANKYFRNIPLDHGFISLGGYMKFSGMLYIVITIYIIFCTKEKPYVEYLPKVEPINTSDGGSKPISIEYDDGDVVSTQNTSSIKYIYRCFIKVLKLKSVRSLAFIHMISKFAFQCNEAATNLKLLEQGFKREDLAVTVLIDLPFEIIFGYYVVKWSSDKDPMIRDNRRLRNSTGTNKVIKFLVGDAGVLTPWLWGFLGRLAAAVLGSYVVKQFPKDGEISTGYFCLVIFQHLLGSFMNTVQFIGISAFHTRVADPVLGGTYMTLLNTLSNFGGTWPRLIIMSMINYFTVYQCTIPGTNKVYVTHGGSMQACTELLNGTVTILRDGYYITNLICIVVGLFLYFGYLKRKILHLQSLPISSWRCT

SEQ ID NO: 67 - DNA, 3363 bp, Saccharomyces cerevisiae
atggttagtaggttttatcagattccaggtacgcatcggccatcgtcggcaatatcttcttcaaatgaatcttcttcactgttgtctgcaaggagaataagtcaaacatatttcaattatcaggcgacccctgaatgccaaaaagtttcctctaagtatgatcctgataacccaaacaaagataagttgggaacatacgatggggtatttgtgcctactgctttaaacgtattgtctatccttatgtttcttcgttttggcttcattttgggtcagttaggtattatatgcaccatcggtcttctgctattgagttacactattaatcttctcaccacgttaagtatatctgctatatctacaaacgggactgttaggggcgggggtgcttattatatgatttcaagaagtttaggacctgaatttggtggatccattgggcttgtctttttcttagggcaggtgttcaatgcaggtatgaacgcagtgggtattatcgaacctttactctataacttgggttattctgctcaaggcgagccacctgcagctttgggagagctactaccaagagggcattggcacgaatttacatatgccacggtcattcttttcttatgtttttctgtggcttttgttggctcgcaaacagtgtcaagagcagggaatattctttttttggtactggcagcttctatattttccattccactttctgcattgataagatcgccattcactgaaggcggtatcagttatacaggtccttcatggcaaacttttcatgataacctgctccctcacttaacaaaaggtgcagcaggttcgttactcaaaggtaaggaaacattcaatgatttatttggcgttttttttcctgctacagctggtatattcgcgggcgcaggaatgtcaagtgaattgagaaagccctctaaatcaattcctaagggtaccttatggggtttacttttcacttttatctgttatgccgttgttgtcttctccatgggttgttccattcccagaagatcgttatatgatgaagtacaaattatacagacgatcagttccgttcagtgggttatattcatgggtgaaatggctacttctcttttctccatcatagtggggatgctcggtgctgcttatgtattagaagcaattgcaaaggataacattattcctggtttggagatttttgctcattcaccgttatattcattgatttttacttggattctaacacagctatgtttgttttcagacgtcaataaaatcgccacatttatcacaatgacattcttaatgacgtttgtggtcatgaatttggcgtgcttcctattaggtatttcctctgctcccaatttcaggccctctttcaaatactttaacaggtatactacagcaattggcgcattactttctgttgttgcgatgttaatagttgatggcatctcagcgtctgtcttgtttttggctatgattttgctatttttattcattcattatttttcaccaccgaagtcttggggtgatgtgtctcaaagtttaatatatcatcaagtgagaaagtatttgcttcgcctacgtcaagacaatattaaatactggaggcctcaaatattgctgtttgtagataatccaaggacgagctggaacttaataaggttttgcaatcatttgaaaaaaggtggtttgtatattttaggccatgttgcagtaactgcggattttccgaagcaactaaatgaattaaaaactcagcagaaagcttggatgaagatcagagacatggcagcaataaaggcttttgtccaagttgggactggtccctcccttatatggggaattaggaatgtttttattggttccgggcttggaggtatgaaaccaaacattactgttgtcggtttttttgacctcgaaagttatagaaagcacatcccacaaagtcgcagccaaaataaccttcagaaacaggtggaaataaaagctacagtgccacgtagtacatgctctgatgtcaaaatcaatgttccattgcctacggatgagtgtaaaaatgaaaccaaagttaatgtacaacaatgggttcaaattgtagaagatctatcactgatgcaatccaatattgccatagcgcatggattcaaaaatttagagataccgaacaaaagggacagctgctttccaaaaaaaactatagatctttatcccatccaaatgtgcggaaaagttgaggcaaagggtgaccagcctgcggctatcactactaactttgatacgtatacactgattctacaattagctgccattttggttactgttcctgaatggaagcgcacacattcgcttcgagttattttatttgtggaacaagaatatcatagaacgaacgaaactcaacgaatgaaaaagctattacaggttctaagaattgacgcagaggttttggtagtatctttagatcaattcagagtatacaacacaattgtcaagggagacccaatcgtgtttgattatgtcaactcgaaattggccgataatgaatggtggaaagatttggttgaagctcgtgatacattaaaaccgaagcggaggttttccactattgaacctcaaacgatagcaaagcaatttacacaatcaagaaaatatacgtctggggttcagaaattgggtgtctcatttacaatgaatacgagaatgccaactaaccgcattgataccccatgcgagagtgaggactccgatttggatacagatcttacgtcaattcgtgatgccttctcggcatcgactaatatttcagtaggtaaggacttaacgaccaaatcgaagaccggttccgacagaacaaatttactcgtaaagaatttacaaagcgatgtgtcaacacagtcgttaagacccgttttctcgagtaatactttgccgaggacgagagtcgtggaagatggcacgggtgaacagccgacactgatcccaattgccgaacctgacctttcgaatgggaacggtactgggagcggtattggcaacggcaacaaattaaagaaaccggttcttcccgaattatcaccttgttgttcaaaagatagtttagtcacagcgatgcaaaatttaggtttcaatgatcttcccagcactgctcaacatttggttctgaatgatgtgatgacacaaatgtcaaagagttcggatttaattttttcaaccttgccagttccagctcttggaacacatgaagatcacgatgcaagtttacaatatgtcgaggacttggatatttggttggagggcttacctccatgcatgttaatcaattcgcaaaccatgacagtaactactgcattatag

SEQ ID NO: 68 - protein, 1120 aa, Saccharomyces cerevisiae
MVSRFYQIPGTHRPSSAISSSNESSSLLSARRISQTYFNYQATPECQKVSSKYDPDNPNKDKLGTYDGVFVPTALNVLSILMFLRFGFILGQLGIICTIGLLLLSYTINLLTTLSISAISTNGTVRGGGAYYMISRSLGPEFGGSIGLVFFLGQVFNAGMNAVGIIEPLLYNLGYSAQGEPPAALGELLPRGHWHEFTYATVILFLCFSVAFVGSQTVSRAGNILFLVLAASIFSIPLSALIRSPFTEGGISYTGPSWQTFHDNLLPHLTKGAAGSLLKGKETFNDLFGVFFPATAGIFAGAGMSSELRKPSKSIPKGTLWGLLFTFICYAVVVFSMGCSIPRRSLYDEVQIIQTISSVQWVIFMGEMATSLFSIIVGMLGAAYVLEAIAKDNIIPGLEIFAHSPLYSLIFTWILTQLCLFSDVNKIATFITMTFLMTFVVMNLACFLLGISSAPNFRPSFKYFNRYTTAIGALLSVVAMLIVDGISASVLFLAMILLFLFIHYFSPPKSWGDVSQSLIYHQVRKYLLRLRQDNIKYWRPQILLFVDNPRTSWNLIRFCNHLKKGGLYILGHVAVTADFPKQLNELKTQQKAWMKIRDMAAIKAFVQVGTGPSLIWGIRNVFIGSGLGGMKPNITVVGFFDLESYRKHIPQSRSQNNLQKQVEIKATVPRSTCSDVKINVPLPTDECKNETKVNVQQWVQIVEDLSLMQSNIAIAHGFKNLEIPNKRDSCFPKKTIDLYPIQMCGKVEAKGDQPAAITTNFDTYTLILQLAAILVTVPEWKRTHSLRVILFVEQEYHRTNETQRMKKLLQVLRIDAEVLVVSLDQFRVYNTIVKGDPIVFDYVNSKLADNEWWKDLVEARDTLKPKRRFSTIEPQTIAKQFTQSRKYTSGVQKLGVSFTMNTRMPTNRIDTPCESEDSDLDTDLTSIRDAFSASTNISVGKDLTTKSKTGSDRTNLLVKNLQSDVSTQSLRPVFSSNTLPRTRVVEDGTGEQPTLIPIAEPDLSNGNGTGSGIGNGNKLKKPVLPELSPCCSKDSLVTAMQNLGFNDLPSTAQHLVLNDVMTQMSKSSDLIFSTLPVPALGTHEDHDASLQYVEDLDIWLEGLPPCMLINSQTMTVTTAL

SEQ ID NO: 69 - DNA, 1425 bp, Saccharomyces cerevisiae
atgagtatttcaaattggatcaccactgcgtatttaattacatcaacatcttttcaacctctttatgggtcattttctgatgcacttggtcgaagaaactgccttttctttgctaatggggcttttaccattggatgtctagcctgtggtttctcgaaaaacatctacatgcttagttttatgagagcattgacaggcataggaggtggtggcttgatcacactttctacaatcgtaaattcagacgttattccaagttcgaaaagaggaatttttcaagcgtttcagaatttacttttgggatttggtgccatatgtggagcgtctttcggtggcacaatagcgtcgagcattggttggaggtggtgttttctcatccaagtacccatatctgtgattagttccatattaatgaattattatgtacctaatcagaaagaatataatcgtcaaaattctagcatattccaaaatcccggaaaaatactcagggacatagatgttatgggctcaattcttattataactggtctcacactacagcttctttacctgagcctggggtgttctacttctaaattatcatggaccagcccttctgtgctactgctattagttgggagtgtaataatcctcttactgttcatattgcacgaaaggaaaacaagtgctagagcgattattcctatggagctggtcaattcctcctacagtgtcgttgtactttcgataagtatacttgttggttttgccagctacgcgtatctttttactttaccattattctttcagattgtacttggagattccactgcaaaagcaggattacgtcttacgattccttccctatttactccggtaggcagtctcataacaggattttccatgagcaagtacaactgtctaagattattactctacattggtatttctttgatgtttttgggtaactttttattcctgtttattgaaaaaacttctccgaactggttgattggtctatttttgatacctgcaaatctaggacaaggtatcacttttcctacgaccttgtttactttcatatttatgttctctaagagtgaccaagctactgcgacatcaactttatatttattccgtagtattggatctgtatggggtgttgcaatttcagctggcgtcattcaattatctttcgcaggtttattgcgtagtaatttgaaaggtctactggatgaaaacaagataaagaaacttattgttcagcttagtgcaaactcctcatatattggatctttacatggcgaagttaaaaacacagtcataaagagttttgatgaggcaacaaagagggctcatctaatgtctacattactctcttcattggccctgatactctgcatccttaaagacaatctggcgaaacctaaaacaagaagataa

SEQ ID NO: 70 - protein, 474 aa, Saccharomyces cerevisiae
MSISNWITTAYLITSTSFQPLYGSFSDALGRRNCLFFANGAFTIGCLACGFSKNIYMLSFMRALTGIGGGGLITLSTIVNSDVIPSSKRGIFQAFQNLLLGFGAICGASFGGTIASSIGWRWCFLIQVPISVISSILMNYYVPNQKEYNRQNSSIFQNPGKILRDIDVMGSILIITGLTLQLLYLSLGCSTSKLSWTSPSVLLLLVGSVIILLLFILHERKTSARAIIPMELVNSSYSVVVLSISILVGFASYAYLFTLPLFFQIVLGDSTAKAGLRLTIPSLFTPVGSLITGFSMSKYNCLRLLLYIGISLMFLGNFLFLFIEKTSPNWLIGLFLIPANLGQGITFPTTLFTFIFMFSKSDQATATSTLYLFRSIGSVWGVAISAGVIQLSFAGLLRSNLKGLLDENKIKKLIVQLSANSSYIGSLHGEVKNTVIKSFDEATKRAHLMSTLLSSLALILCILKDNLAKPKTRR

SEQ ID NO: 71 - DNA, 1845 bp, Saccharomyces cerevisiae
atgaagggattatcctcattaataaacagaaaaaaagacaggaacgactcacacttagatgagatcgagaatggcgtgaacgctaccgaattcaactcgatagagatggaggagcaaggtaagaaaagtgattttgatctttcccatcttgagtacggtccaggttcactaataccaaacgataataatgaagaagtccccgaccttctcgatgaagctatgcaggacgccaaagaggcagatgaaagtgagaggggaatgccactcatgacagctttgaagacatatccaaaagctgctgcttggtcactattagtttccacaacattgattcaagagggttatgacacagccattctaggagctttctatgccctgcctgtttttcaaaaaaaatatggttctttgaatagcaatacaggagattatgaaatttcagtttcctggcaaatcggtctatgtctatgctacatggcaggtgagattgtcggtttgcaaatgactgggccttctgtagattacatgggcaaccgttacactctgatcatggcgttgttctttttagcggctttcattttcattctgtatttttgcaagagtttgggtatgattgccgtgggacaggcattgtgtggtatgccatggggttgtttccaatgtttgaccgtttcttatgcttctgaaatttgtcctttggccctaagatactatttgacgacttattctaatttatgttgggcgttcggtcaacttttcgctgctggtattatgaaaaattcccagaacaaatatgccaactcagaactaggatataagctaccttttgctttgcagtggatctggccccttcctttggcggtaggtattttttttgcaccagagtctccatggtggctggttaaaaaaggaaggattgatcaagcgaggagatcacttgaaagaacattaagtggtaaaggacccgagaaagaattactagtgagtatggaactcgataaaatcaaaactactatagaaaaggagcagaaaatgtctgatgaaggaacttactgggattgtgtgaaagatggtattaacaggagaagaacgagaatagcttgtttatgttggatcggtcaatgctcctgtggtgcatcattaattggttattcaacttacttttatgaaaaagctggtgttagcactgatacggcttttactttcagtattatccaatattgtcttggtattgctgcaacgtttatatcctggtgggcttcaaaatattgtggcagatttgacctttatgcttttgggctggcttttcaggctattatgttcttcattatcggtggtttaggatgttcagacactcatggcgctaaaatgggtagtggtgctcttctaatggttgtcgcgttcttttacaacctcggtattgcacctgttgttttttgcttagtgtctgaaataccgtcttcaaggctaagaaccaaaacaattattttggctcgtaatgcttacaatgtgatccaagttgtagttacagttttgatcatgtaccaattgaactcagagaaatggaattggggtgctaaatcaggctttttctggggaggattttgtctggccactttagcttgggctgttgtcgatttaccagaaaccgctggcaggacttttattgagataaatgaattgtttagacttggtgttccagcaagaaagttcaagtcgactaaagtcgacccttttgcagctgccaaagcagcagctgcagaaattaatgttaaagatccgaaggaagatttggaaacttctgtggtagatgaagggcgaaacacctcatctgttgtgaacaaatga

SEQ ID NO: 72 - protein, 614 aa, Saccharomyces cerevisiae
MKGLSSLINRKKDRNDSHLDEIENGVNATEFNSIEMEEQGKKSDFDLSHLEYGPGSLIPNDNNEEVPDLLDEAMQDAKEADESERGMPLMTALKTYPKAAAWSLLVSTTLIQEGYDTAILGAFYALPVFQKKYGSLNSNTGDYEISVSWQIGLCLCYMAGEIVGLQMTGPSVDYMGNRYTLIMALFFLAAFIFILYFCKSLGMIAVGQALCGMPWGCFQCLTVSYASEICPLALRYYLTTYSNLCWAFGQLFAAGIMKNSQNKYANSELGYKLPFALQWIWPLPLAVGIFFAPESPWWLVKKGRIDQARRSLERTLSGKGPEKELLVSMELDKIKTTIEKEQKMSDEGTYWDCVKDGINRRRTRIACLCWIGQCSCGASLIGYSTYFYEKAGVSTDTAFTFSIIQYCLGIAATFISWWASKYCGRFDLYAFGLAFQAIMFFIIGGLGCSDTHGAKMGSGALLMVVAFFYNLGIAPVVFCLVSEIPSSRLRTKTIILARNAYNVIQVVVTVLIMYQLNSEKWNWGAKSGFFWGGFCLATLAWAVVDLPETAGRTFIEINELFRLGVPARKFKSTKVDPFAAAKAAAAEINVKDPKEDLETSVVDEGRNTSSVVNK

SEQ ID NO: 73 - DNA, 3150 bp, Saccharomyces cerevisiae
atgggaagtcatcgacgttatctctactatagtatattatcatttctattattatcctgctcagtggtacttgcaaaacaagataagaccccattctttgaaggtacttcttcgaaaaattcgcgtctaactgcacaagataagggcaatgatacatgcccgccatgttttaattgtatgctacctatttttgaatgcaaacagttttctgaatgcaattcgtacactggtagatgtgagtgtatagaagggtttgcaggtgatgattgctctctgcccctctgtggcggtctatcaccggatgaaagcggtaataaggatcgtcccataagagcacaaaatgacacctgtcattgtgataacggatggggagggatcaattgtgacgtttgtcaagaagattttgtctgtgatgcgttcatgcctgatcctagtattaaggggacatgttataagaatggtatgattgtagataaagtattttcaggttgtaatgtgaccaatgagaaaattctacagattttgaacggcaaaataccacaaattacatttgcctgtgataaacctaatcaagaatgtaattttcagttttggatagatcagttagaaagcttctattgtggcttaagtgattgtgcctttgaatacgacttggaacagaatacctcccattataagtgtaatgacgttcaatgcaaatgcgttcccgacactgtgttgtgtggtgctaaggggtctatagatatctcggatttcctgacagagacaataaaagggccaggagatttcagctgtgatttagaaacaaggcaatgtaaattcagtgagccttctatgaatgatttgatattgaccgtgtttggtgacccttatattactttgaagtgtgaatccggtgaatgtgttcattatagtgagattccaggttacaaatctccttcaaaagatccaacagtgtcatggcaagggaaattggtgttggcattgactgctgtgatggtcctggcactttttacatttgctaccttttacatttctaaatctccgttattcagaaatggattgggttcctcaaagtctcccattcgtttgccagatgaagatgcggtgaataatttcttacaaaatgaagatgacacactggcgacattaagttttgaaaatatcacttatagtgtcccctcgataaattcagatggtgttgaagaaactgtgctgaatgaaataagtggtatcgtgaagcccggccaaatattagctatcatgggtggatctggtgcgggtaaaactactttattagatatcctagcaatgaaacggaaaacaggtcacgtttcgggttccataaaagttaacggtattagtatggaccgtaaatctttctcgaaaataatcgggttcgtcgatcaagatgactttttgctgcccactttgactgtttttgaaaccgtattaaatagtgcgctgttaagattgccaaaagcattgtcattcgaggccaagaaggcaagagtttataaggtgttggaagaactaagaattattgatatcaaagatcgtattattggtaatgaatttgatcgtggtattagtggaggtgaaaaacgccgagtttccattgcatgtgaattagtgacatctccattggttttatttttggatgaacctacatctggtttagatgctagtaatgccaataatgttattgaatgtttggtaaggttatccagcgactataacaggacattggtgctatctattcatcagccaagatcaaatatattttatttattcgataaattggtcctgttaagtaaaggtgagatggtctattccggaaatgccaaaaaagtgtcagaatttttgagaaatgagggatatatctgtccggacaactataatattgctgattatttgattgatattacttttgaagccggtcctcaggggaaaaggagaagaatcagaaacatttccgatttagaagctggtacggatactaacgatattgataatacgatacaccaaacaacatttactagcagtgatggtacaacacagagagagtgggctcatcttgcagctcatagagatgagatcagatctttactcagagatgaagaagatgtagagggaacagatggaaggcgaggtgctactgagattgacttaaataccaaactactacacgataaatataaagatagcgtctattatgcagagctttcacaggagatcgaggaagttttaagcgaaggtgatgaggaaagtaacgttttgaatggagatttacccacaggtcaacaatctgctggttttctgcaacagttatcgatattgaattcaagaagttttaaaaacatgtacagaaaccctaaactattattgggtaattatttactgacgatcctattgagtttattcttgggaacactatattacaacgtctccaatgatatcagcggttttcagaacagaatggggctgttcttctttatactaacgtacttcggttttgttacattcacaggtctcagctcgttcgctctggaaaggatcattttcataaaagaaagatccaataactattactcgccacttgcatactacattagtaagataatgagcgaagtggtcccgctacgtgttgtaccacctatactcttgtcattgattgtttacccaatgactggtttaaacatgaaagacaatgctttttttaaatgtattggaatccttatactgtttaaccttgggatatcgttggaaatcctaaccatcggcataatttttgaagacttgaataactccataatattaagcgtgctggtgcttttgggctcactactgtttagcggactatttatcaatactaagaatattacaaacgtggccttcaagtacctgaaaaacttctctgtgttttactacgcctacgaatctttattgatcaatgaggtcaaaacattgatgctgaaagagagaaagtacggcttaaatattgaagttccaggcgctactatcttgagcacatttggatttgttgtccaaaaccttgtatttgacatcaagatcctggctctgtttaatgtggtgtttttaataatggggtatctagcccttaagtggatagttgtggaacaaaagtag

SEQ ID NO: 74 - protein, 1049 aa, Saccharomyces cerevisiae
MGSHRRYLYYSILSFLLLSCSVVLAKQDKTPFFEGTSSKNSRLTAQDKGNDTCPPCFNCMLPIFECKQFSECNSYTGRCECIEGFAGDDCSLPLCGGLSPDESGNKDRPIRAQNDTCHCDNGWGGINCDVCQEDFVCDAFMPDPSIKGTCYKNGMIVDKVFSGCNVTNEKILQILNGKIPQITFACDKPNQECNFQFWIDQLESFYCGLSDCAFEYDLEQNTSHYKCNDVQCKCVPDTVLCGAKGSIDISDFLTETIKGPGDFSCDLETRQCKFSEPSMNDLILTVFGDPYITLKCESGECVHYSEIPGYKSPSKDPTVSWQGKLVLALTAVMVLALFTFATFYISKSPLFRNGLGSSKSPIRLPDEDAVNNFLQNEDDTLATLSFENITYSVPSINSDGVEETVLNEISGIVKPGQILAIMGGSGAGKTTLLDILAMKRKTGHVSGSIKVNGISMDRKSFSKIIGFVDQDDFLLPTLTVFETVLNSALLRLPKALSFEAKKARVYKVLEELRIIDIKDRIIGNEFDRGISGGEKRRVSIACELVTSPLVLFLDEPTSGLDASNANNVIECLVRLSSDYNRTLVLSIHQPRSNIFYLFDKLVLLSKGEMVYSGNAKKVSEFLRNEGYICPDNYNIADYLIDITFEAGPQGKRRRIRNISDLEAGTDTNDIDNTIHQTTFTSSDGTTQREWAHLAAHRDEIRSLLRDEEDVEGTDGRRGATEIDLNTKLLHDKYKDSVYYAELSQEIEEVLSEGDEESNVLNGDLPTGQQSAGFLQQLSILNSRSFKNMYRNPKLLLGNYLLTILLSLFLGTLYYNVSNDISGFQNRMGLFFFILTYFGFVTFTGLSSFALERIIFIKERSNNYYSPLAYYISKIMSEVVPLRVVPPILLSLIVYPMTGLNMKDNAFFKCIGILILFNLGISLEILTIGIIFEDLNNSIILSVLVLLGSLLFSGLFINTKNITNVAFKYLKNFSVFYYAYESLLINEVKTLMLKERKYGLNIEVPGATILSTFGFVVQNLVFDIKILALFNVVFLIMGYLALKWIVVEQK

SEQ ID NO: 75 - DNA, 1836 bp, Saccharomyces cerevisiae
atggcgcgtcaaaagcttactttcaaagaacaaatggatggtttcccctgggtccaacttgttgttgtgtccttagttaggttcagcgaaccaattgcgttttcgtcactatttccttatgtttatttcatggttagagattttaatattgctcccaatgatgctcaagtgtccaaatattcaggttatttatcttcatcatttgcgttatgccaagtcatatctgcgtaccactggggtagattctctgaaaagcatggcagaaaaataacattgacttgcgggcttataggaacatctgtatcattgttaatactgggattttcacgcaatttctatcaggctttggtggcaagaagtttaatgggattgctaaatggtaacgtcggcgttattagaaccattattggtgaaatagcaactgaaagaaaacatcaggctttagctttcagtactatgcctttattatttcaatttggtgccgttgttgggcctatgatcggtgggtttcttgtatttagagatggaacaatgaatgaagtgccactatggtttccacattttgcaaaaagaataattaggtcatatccgtacgccttgccaaacgtggtagtgtgcatgtttttgatgtttggtttaactaatgcaacattgtttttggaagaaacacatcctgcttttaaagatagaagagattacggtttagaggtcggtgattttattaagaagaatatatttggtatacagccgaaaagaagaccctggcaaaagcgcattcaggatgattcggaaaacattcaccaccgtaatgagaatgtgaacagcattcgaggacaagatagtgaagaggatgaaaatagtcccctagtgaatactaccaatgacgatgatactgaaagcatacaatcgattgatcctattttaacaagaagacagtctgtaggcctgattaggacatattctctgcatgaaccaacagacgctgtgcatgccaatatagatacagctccagacggttgtaaagaaagtagtatatttcatcacgtttttcatacaaaagtattttaccctatatcggtgaattttattatggctttacatttgattgtatacaacgaatttttgcctgtttttttagcttatgatttagccgtagatccagaaaatccaaagaagctggcttcaaaatttccgtggaaaatatctggcggtataggttatgaaccagaacaaaccggtactcttttgtcgacaacaggtatctttggttgttttgtggttattttcatttttcccatagttgatcgaaatttcgattgtttaacaattttcagaactttagtcaagctgtaccctattatgtacgttatggttccttacgttgtttttctacagaatgaacggattcctagctggtatactgtcgtctacttgtacataatcacagggataaaaacattttgtggcgctttaacgtcaccacaaattatgttattaattcataattcgagtcccttgagttgtagatcagtcatcaatggcgccaccattagtatttctgcctctgctcgtttcataggtcccttagtatggggctatattatgtcttggtcccagcaaaatgacgtcgcctgggtcagttggtggtcgttaagtcttttttgtatggtagctctttatcaaagttataagatagcaccaattgatgataacgaaaatgagcttcatggacagggtagtgaagatgcctacaattcgcagtcacagtcttctgatttaagaatggctcatcgatctagtttaagcagcttaagtaaccaacgctgtaccacatga

SEQ ID NO: 76 - protein, 611 aa, Saccharomyces cerevisiae
MARQKLTFKEQMDGFPWVQLVVVSLVRFSEPIAFSSLFPYVYFMVRDFNIAPNDAQVSKYSGYLSSSFALCQVISAYHWGRFSEKHGRKITLTCGLIGTSVSLLILGFSRNFYQALVARSLMGLLNGNVGVIRTIIGEIATERKHQALAFSTMPLLFQFGAVVGPMIGGFLVFRDGTMNEVPLWFPHFAKRIIRSYPYALPNVVVCMFLMFGLTNATLFLEETHPAFKDRRDYGLEVGDFIKKNIFGIQPKRRPWQKRIQDDSENIHHRNENVNSIRGQDSEEDENSPLVNTTNDDDTESIQSIDPILTRRQSVGLIRTYSLHEPTDAVHANIDTAPDGCKESSIFHHVFHTKVFYPISVNFIMALHLIVYNEFLPVFLAYDLAVDPENPKKLASKFPWKISGGIGYEPEQTGTLLSTTGIFGCFVVIFIFPIVDRNFDCLTIFRTLVKLYPIMYVMVPYVVFLQNERIPSWYTVVYLYIITGIKTFCGALTSPQIMLLIHNSSPLSCRSVINGATISISASARFIGPLVWGYIMSWSQQNDVAWVSWWSLSLFCMVALYQSYKIAPIDDNENELHGQGSEDAYNSQSQSSDLRMAHRSSLSSLSNQRCTT

SEQ ID NO: 77 - DNA, 1065 bp, Saccharomyces cerevisiae
atggatttaaccgtggaacctaatttgcactctttaattacctctaccactcataagtggattttcgttggtggtaaaggtggtgttggtaagactacttcatcatgttccattgctatccaaatggctttgagtcaaccaaacaaacagttcctactgatctctactgatcctgcccataacttaagtgatgcattcggtgagaaatttggtaaagacgccagaaaggtgacaggcatgaataatctatcatgtatggaaatcgatccatccgctgctttgaaggatatgaacgacatggcagtttcacgcgctaacaataacggaagtgacggtcaaggtgacgatctaggaagcttgcttcaaggtggtgctcttgctgatttgaccggttccatccctggtatcgacgaagctttatccttcatggaagtcatgaagcacattaaaaggcaagaacagggcgaaggtgaaaccttcgatactgttatttttgacactgctccaactggccacacattaagatttctacaactaccaaatactttatccaagcttttggaaaagttcggtgaaattaccaacaaattgggcccaatgctaaactcttttatgggcgcaggtaatgtcgatatctctggaaaattgaacgagttaaaggctaatgtcgagaccatcagacaacaattcacggatcctgacctaacgacttttgtttgcgtttgtatcagtgaattcttatccttatatgaaactgaaagactaattcaggaattgatttcctacgatatggacgttaattccatcattgtcaaccaattattatttgctgaaaacgatcaagagcacaactgtaagagatgtcaggcaagatggaagatgcaaaagaagtacttggaccaaatcgacgaattgtacgaagatttccatgtcgttaaaatgccattatgtgctggagaaatcagaggcttaaataacttaacaaagttctcacagttcctaaacaaagaatataaccctattactgatggcaaagtcatttatgagttagaagataaggaatag

SEQ ID NO: 78 - protein, 354 aa, Saccharomyces cerevisiae
MDLTVEPNLHSLITSTTHKWIFVGGKGGVGKTTSSCSIAIQMALSQPNKQFLLISTDPAHNLSDAFGEKFGKDARKVTGMNNLSCMEIDPSAALKDMNDMAVSRANNNGSDGQGDDLGSLLQGGALADLTGSIPGIDEALSFMEVMKHIKRQEQGEGETFDTVIFDTAPTGHTLRFLQLPNTLSKLLEKFGEITNKLGPMLNSFMGAGNVDISGKLNELKANVETIRQQFTDPDLTTFVCVCISEFLSLYETERLIQELISYDMDVNSIIVNQLLFAENDQEHNCKRCQARWKMQKKYLDQIDELYEDFHVVKMPLCAGEIRGLNNLTKFSQFLNKEYNPITDGKVIYELEDKE

SEQ ID NO: 79 - DNA, 924 bp, Saccharomyces cerevisiae
atgactgagcaagcaactaagccaagaaattcatcgcatttgatcgggggctttttcggtgggctaacatctgctgttgcgttgcaacctttagaccttttgaagacgagaatccagcaagacaagaaagctacattatggaaaaatttgaaagagatagacagccctctacagctatggagaggtacattaccttcagcattacgaacatcaataggcagcgccttatatttatcatgtttgaaccttatgcgctcatctttggcaaagaggaggaatgctgtgccttcattaacaaacgattcaaacattgtatataacaagagcagtagcttaccacgattaacgatgtatgaaaatttactaacaggtgcatttgcaagaggtttggtaggttatataaccatgcctatcaccgtcattaaagtccgttatgagtctactctgtacaattactccagtttaaaggaggcaattacccatatatatactaaggaaggactttttggatttttcagagggtttggagctacttgtttaagagacgctccctatgcaggtttgtatgtgctgctatatgaaaaatcgaaacaattactgcccatggtattaccttctaggtttatacattacaatcctgagggaggatttactacttatacctctacaacagtaaatacaacaagcgccgtactatccgccagtttagccaccacagtaacggcaccgttcgacaccataaaaacgagaatgcaattggaaccatcaaaatttaccaactccttcaatacatttacatctatagttaaaaatgaaaatgtgctgaagttatttagcgggttaagcatgaggctggcaagaaaggccttcagtgcaggtattgcgtggggtatatatgaggagttggtcaaaagattcatgtaa

SEQ ID NO: 80 - protein, 307 aa, Saccharomyces cerevisiae
MTEQATKPRNSSHLIGGFFGGLTSAVALQPLDLLKTRIQQDKKATLWKNLKEIDSPLQLWRGTLPSALRTSIGSALYLSCLNLMRSSLAKRRNAVPSLTNDSNIVYNKSSSLPRLTMYENLLTGAFARGLVGYITMPITVIKVRYESTLYNYSSLKEAITHIYTKEGLFGFFRGFGATCLRDAPYAGLYVLLYEKSKQLLPMVLPSRFIHYNPEGGFTTYTSTTVNTTSAVLSASLATTVTAPFDTIKTRMQLEPSKFTNSFNTFTSIVKNENVLKLFSGLSMRLARKAFSAGIAWGIYEELVKRFM

SEQ ID NO: 81 - DNA, 2292 bp, Saccharomyces cerevisiae
atgaacgatagccaaaactgcctacgacagagggaagaaaatagtcatctgaatcctggaaatgacttcggccaccaccagggtgcagaatgtacgataaatcataacaacatgccacaccgcaatgcatacacagaatctacgaatgacacggaagcaaagtccatagtgatgtgcgacgatcctaacgcataccaaatttcctacacaaataatgagccggcgggagatggagctatagaaaccacgtccattctactatcgcaaccgctgccgctgcgatcgaatgtgatgtctgtcttggtaggcatatttgttgccgtggggggcttcttgtttgggtatgacactggacttataaacagtatcacggatatgccgtatgttaaaacctacattgctccgaaccattcatatttcaccactagccaaatagccatactcgtatcattcctctccctaggaacatttttcggtgcgttaatcgctccctatatttcagattcatatggtaggaagccaacaattatgtttagtaccgctgttatcttttccatcggaaactcattacaggtggcatccggtggcttggtgctattaatcgtcggaagagtgatctcaggtatcgggatcgggataatctctgctgtggttcctctttatcaagctgaagctgcgcagaagaaccttagaggtgccatcatttccagttatcagtgggctatcactattgggttactcgtgtccagtgcagtatcgcaaggaactcattccaaaaatggcccgtcttcatatagaataccaattggtttgcagtacgtttggtcaagtattttagctgtgggcatgatattccttccagagagtccaagatattacgtcttgaaggatgaactcaataaagctgcaaaatcgttatcctttttaagaggcctcccgatcgaagatccaagactcttagaggagcttgttgaaataaaagccacttacgattatgaagcatcgttcggcccgtcaacacttttagattgtttcaaaacaagtgaaaatagacccaaacagattttacgaatatttactggtatcgccatacaagcttttcaacaggcatctggtatcaattttatattctactatggagttaattttttcaacaacacaggggtggacaactcttacttggtttcttttatcagctatgccgtcaacgtcgccttcagtataccgggtatgtatttagtggatcgaattggtagaagaccagtccttcttgctggaggtgtcataatggcaatagcaaatttagtcattgccatcgttggtgtttccgagggaaaaactgttgttgctagtaaaattatgattgcttttatatgccttttcattgctgcattttcggcgacatggggtggtgtcgtgtgggtggtatctgctgaactgtacccacttggtgtcagatcgaaatgtaccgccatatgcgctgccgcaaattggctagttaatttcacctgtgccctgattacaccttacattgttgatgtcggatcacacacttcttcaatggggcccaaaatattcttcatttggggcggcttaaatgtcgtggccgttatcgttgtttatttcgctgtttatgaaacgaggggattgactttggaagagattgacgagttatttagaaaggccccaaatagcgtcatttctagcaaatggaacaaaaaaataaggaaaaggtgcttagcctttcccatttcacaacaaatagagatgaaaactaatatcaagaacgctggaaagttggacaacaacaacagtccaattgtacaggatgacagccacaacataatcgatgtggatggattcttggagaaccaaatacagtccaatgatcatatgattgcggcggataaaggaagtggctcgttagtaaacatcatcgatactgcccccctaacatctacagagtttaaacccgtggaacatccgccagtaaattacgtcgacttggggaatggtttgggtctgaatacatacaatagaggtcctccttctatcatttctgactctactgatgagttctatgaggaaaatgactcttcttattacaataacaacactgaacgaaatggagctaacagcgtcaatacatatatggctcaactaatcaatagctcatctactacaagcaacgacacatcgttctctccatcacacaatagcaatgcaagaacgtcctctaattggacgagtgacctcgctagtaagcacagccaatacacttccccccaataa

SEQ ID NO: 82 - protein, 763 aa, Saccharomyces cerevisiae
MNDSQNCLRQREENSHLNPGNDFGHHQGAECTINHNNMPHRNAYTESTNDTEAKSIVMCDDPNAYQISYTNNEPAGDGAIETTSILLSQPLPLRSNVMSVLVGIFVAVGGFLFGYDTGLINSITDMPYVKTYIAPNHSYFTTSQIAILVSFLSLGTFFGALIAPYISDSYGRKPTIMFSTAVIFSIGNSLQVASGGLVLLIVGRVISGIGIGIISAVVPLYQAEAAQKNLRGAIISSYQWAITIGLLVSSAVSQGTHSKNGPSSYRIPIGLQYVWSSILAVGMIFLPESPRYYVLKDELNKAAKSLSFLRGLPIEDPRLLEELVEIKATYDYEASFGPSTLLDCFKTSENRPKQILRIFTGIAIQAFQQASGINFIFYYGVNFFNNTGVDNSYLVSFISYAVNVAFSIPGMYLVDRIGRRPVLLAGGVIMAIANLVIAIVGVSEGKTVVASKIMIAFICLFIAAFSATWGGVVWVVSAELYPLGVRSKCTAICAAANWLVNFTCALITPYIVDVGSHTSSMGPKIFFIWGGLNVVAVIVVYFAVYETRGLTLEEIDELFRKAPNSVISSKWNKKIRKRCLAFPISQQIEMKTNIKNAGKLDNNNSPIVQDDSHNIIDVDGFLENQIQSNDHMIAADKGSGSLVNIIDTAPLTSTEFKPVEHPPVNYVDLGNGLGLNTYNRGPPSIISDSTDEFYEENDSSYYNNNTERNGANSVNTYMAQLINSSSTTSNDTSFSPSHNSNARTSSNWTSDLASKHSQYTSPQ

SEQ ID NO: 83 - DNA, 2064 bp, Saccharomyces cerevisiae
atgaaacctccgttaaacatgtcacgttcaaataaaccacttactcaggaagctaatagttcggcgcatattgatagggcacatcagctagcacaggattttaacagtaaacaggatgataccgcactaacttcactgccccacaagaaccccgacatattcagatttgagaacaacatcacagctcatagctcgcgtcgtggttctctatatagagacagcgatgctactgtggttttgccgctttctgaacatacccctagattatcaatggatgatccataccgccaattactacaacaggctgaaatctcacaactacgaagtaagaaaaaaaggcattccagtcgagttttgcgtacttcgtttatatcttttgtggtgctagtttcctcgctgtcagggttggaccaaggcctcatatctggtaacgttatgactttgtcgttccagaagtattttcattacccacttacttctccgctgggcaatatagtgagcattgttaatctgggtgcgttcatggcgtcgttatttgtctattctggcatcctggagccttgtagcaggaaaaaaatgctccaaataagcacaatgatatactctttgggtgccattgttcaggtcttggctctaaaccaatggtgtttactactgggtagattcttactcggagtaggtatgggctttgccttttctatggtaataatttatcaattcgagtttccccttccctgtataagaaaacggacattaatttccattcaatgcgtctctagtgtcattgcgtattcattcggaatatggattaattgtgctttcagatatttgggctttgcatggagataccctttgtcaacacatgtggcacttggaataatactaaacctaatgtcgttctatcttattttagagtccccttcgtggctgttgaagcaaaagaacgacgtagaggcattggttttaatatcgaatgttttcgatgatggaaatttcgaagaaaaccaaactcagttgaaatttagggtcctgaaacgagacatattattaaagtcacaccttcaaaaaaactcctatccatatgcgtatatcttaaaggatttttcttcaataataaaattgttgataggtttccaacttctcacacgaacaaatggagtggatgctttcttgtattactcaccgttaatattacaacaaatggggagaggagaaagaaaatctatctatttaacggggcttaatgctttaatttacagcatcgtaatattagcatatgttcccttggtgttacggaaacgtaaagagaaaacgaatgtactcttaggttcgattgtgatgtgtgcattgctatttaccatatcttttacagactggtttcccaagagcacaacgaggtatatatcaatactatttgctgtttttctttttacgcacttcatcagttgggattctataggatgggttatgaccattgagcttctacctcacttgtcacaggccccagtgatactactagtctcaaacttttattggatttttaagtggttcgtcagcttaataacccctatacttattgaccgtctgtcttggaagttttatcttattccatctttatcttcctttatttccattatatttgtgctgaagatttttcctatagaaacccgtgacgaaaggttagattctgatgatgattctaccggaaacggtagcggtaaccatgatgatgtttttgacgataccggttctgaattctcctcctcaccatctttttccgcgtatcagataaacactctaggaagtagtatcaaacaaaataatcaagcctattcatctattcaaaatgagcagattctacccaaaaacggaaacttatcgaaccagacacacggttctgcacaaaatgtttatttcattacatctgattcaggaccatcaaggactggagaatttttcagttttcataacagaaccgatccaaatatcagcgacaacattgctgcgaataaacccagttcaggtggaggccagaattcgcctggagacatggcagttgcctag

SEQ ID NO: 84 - protein, 687 aa, Saccharomyces cerevisiae
MKPPLNMSRSNKPLTQEANSSAHIDRAHQLAQDFNSKQDDTALTSLPHKNPDIFRFENNITAHSSRRGSLYRDSDATVVLPLSEHTPRLSMDDPYRQLLQQAEISQLRSKKKRHSSRVLRTSFISFVVLVSSLSGLDQGLISGNVMTLSFQKYFHYPLTSPLGNIVSIVNLGAFMASLFVYSGILEPCSRKKMLQISTMIYSLGAIVQVLALNQWCLLLGRFLLGVGMGFAFSMVIIYQFEFPLPCIRKRTLISIQCVSSVIAYSFGIWINCAFRYLGFAWRYPLSTHVALGIILNLMSFYLILESPSWLLKQKNDVEALVLISNVFDDGNFEENQTQLKFRVLKRDILLKSHLQKNSYPYAYILKDFSSIIKLLIGFQLLTRTNGVDAFLYYSPLILQQMGRGERKSIYLTGLNALIYSIVILAYVPLVLRKRKEKTNVLLGSIVMCALLFTISFTDWFPKSTTRYISILFAVFLFTHFISWDSIGWVMTIELLPHLSQAPVILLVSNFYWIFKWFVSLITPILIDRLSWKFYLIPSLSSFISIIFVLKIFPIETRDERLDSDDDSTGNGSGNHDDVFDDTGSEFSSSPSFSAYQINTLGSSIKQNNQAYSSIQNEQILPKNGNLSNQTHGSAQNVYFITSDSGPSRTGEFFSFHNRTDPNISDNIAANKPSSGGGQNSPGDMAVA

SEQ ID NO: 85 - DNA, 1716 bp, Saccharomyces cerevisiae
atgagtatgtcaagcaaaaacgagaataagatatcagtagaacaaagaatatccactgatatcggtcaggcttaccagttacaaggccttgggtctaacctaaggtcgattcgctccaagactggtgccggtgaagtgaactatatcgatgctgctaaatctgtaaatgataaccaactgcttgcagagatcggttataaacaagaattaaaaagacaattttcaacattacaagttttcggtattgcgttctccattatgggtctattgccctccattgcatctgtgatgggtggtgggctcggtggtggtccagcaacattagtgtggggttggttcgttgctgcgtttttcattttactggtgggtattaccatggctgaacatgcaagttccattcctaccgctggtggtttgtactactggacgtattactatgctccagaaggttataaagagattatttcttttattattggttgctcaaactccctagcgttggcagccggtgtgtgttccattgattacggtttggctgaggaaattgctgctgctgtcacattaaccaaagatggaaattttgaagtaacgagtgggaaactttacggtatatttgctggagcagtggtggttatgtgtatttgtacatgtgttgcttctggggccattgctcgtctgcagacgctaagtatatttgccaatcttttcattattgttttattgttcattgcgctaccgattggtaccaagcatagaatgggaggtttcaatgatggtgactttatatttgggaaatatgaaaacttaagtgactggaataatggttggcaattttgtcttgctggtttcatgcctgctgtctggactattggttcctttgattcatgtgtccatcaatctgaagaagccaaagatgccaagaaatcagtccccattggtataatctcatctattgctgtttgttggattttaggttggttgattattatttgtttaatggcctgtatcaaccctgatattgacagcgttttggactccaagtacggctttgctttggctcaaataatttatgattcgttaggaaaaaaatgggccattgcatttatgtcattgatcgcattctgtcaatttctaatgggtgcttccattaccacagctgtttctagacaagtttgggcattttcccgtgataacggtttgcccctatcaaagtatattaaaagagtggattctaaatactcggtcccttttttcgctattttggctgcctgtgtaggttccttgattttaggattgttatgtttgattgatgatgccgccactgatgcattatttagtctggctgttgcaggaaacaatttggcatggagtacccctacagttttccgtttaacatcaggtagagatttatttagacctggtccattttatttgggtaaaatctggtctccaattgttgcttggacaggtgttgctttccaattgttcattattattttggttatgttcccctctcaacaacatggtattactaaatccacaatgaattatgcatgcgttattggtcccggtatctggatccttgcaggtatctactacaaagtttacaagaagaaatactaccacggtccagcaaccaatttgtcggatgatgattatactgaagccgttggtgctgatgttatcgacacaattatgtccaaacaggaaccataa

SEQ ID NO: 86 - protein, 571 aa, Saccharomyces cerevisiae
MSMSSKNENKISVEQRISTDIGQAYQLQGLGSNLRSIRSKTGAGEVNYIDAAKSVNDNQLLAEIGYKQELKRQFSTLQVFGIAFSIMGLLPSIASVMGGGLGGGPATLVWGWFVAAFFILLVGITMAEHASSIPTAGGLYYWTYYYAPEGYKEIISFIIGCSNSLALAAGVCSIDYGLAEEIAAAVTLTKDGNFEVTSGKLYGIFAGAVVVMCICTCVASGAIARLQTLSIFANLFIIVLLFIALPIGTKHRMGGFNDGDFIFGKYENLSDWNNGWQFCLAGFMPAVWTIGSFDSCVHQSEEAKDAKKSVPIGIISSIAVCWILGWLIIICLMACINPDIDSVLDSKYGFALAQIIYDSLGKKWAIAFMSLIAFCQFLMGASITTAVSRQVWAFSRDNGLPLSKYIKRVDSKYSVPFFAILAACVGSLILGLLCLIDDAATDALFSLAVAGNNLAWSTPTVFRLTSGRDLFRPGPFYLGKIWSPIVAWTGVAFQLFIIILVMFPSQQHGITKSTMNYACVIGPGIWILAGIYYKVYKKKYYHGPATNLSDDDYTEAVGADVIDTIMSKQEP

SEQ ID NO: 87 - DNA, 1704 bp, Saccharomyces cerevisiae
atggcaagcgaacagtcctcaccagaaattaatgcagataatctaaacagtagtgcagctgacgttcatgtacagccacccggagagaaagaatggtcagacgggttttatgacaaagaagtcattaatggaaatacgccagacgcaccgaagagaggctttttaggttaccttattatctacttactatgctatcctgtatcctttggcggttttttacctggttgggatagtggtattactgcaggcttcatcaatatggataactttaaaatgaattttggttcttacaagcacagtactggtgagtattatttgagcaacgtgcgtatgggtcttctcgtggccatgttcagtgtaggatgttccattggcggtgttgcttttgcgagacttgctgatactttaggtagaaggctagcaattgtaatcgtggttttggtatatatggttggtgcaattattcagatcagttcgaatcacaaatggtaccaatactttgtcggtaagatcatctacggtcttggtgctggtggctgttcggtgttgtgtccaatgcttttatctgaaatagcccccacagatttgagaggtggacttgtctcattgtaccaacttaacatgaccttcggtattttcttgggttattgtagcgtttatggaacaaggaagtatagtaatactgcgcaatggaggattcctgtgggactatgctttctgtgggctctaattatcatcgttggcatgttattagttccagagtccccaagatatctgattgaatgtgagagacatgaagaggcctgtgtctccatcgccaagatcaacaaggtttcaccagaggatccatgggtactcaaacaggctgatgaaatcaacgccggtgtccttgcccaaagagaactaggggaagcctcatggaaagaacttttctccgtcaaaacaaaagtccttcaacgtttgatcacaggtattcttgtgcaaacctttttgcaacttactggtgaaaactacttcttcttctacggaactaccattttcaaatcagttgggcttactgatgggtttgagacttcgatcgtcctaggtacagtgaatttcttctccactattattgctgttatggtcgtagacaaaataggccgtcgtaaatgtctgttattcggagcggcttcaatgatggcttgtatggtcatatttgcaagtatcggggtaaaatgtctttaccctcatggccaggatggtccatcctcgaaaggtgcaggtaatgccatgattgtgttcacatgcttctatatattctgctttgcaacgacatgggcccctgttgcttatattgtggttgccgagtcattcccttcgaaggtcaaatctaaagcaatgtcaatttcgactgcattcaactggttatggcaattcttgattggttttttcacaccattcattactgggtctatccacttctattatggttatgtgttcgtaggttgtttggttgctatgtttttgtacgttttcttctttttaccagaaacaattggtctatctttggaggaaatccagttactatatgaagaaggtataaaaccatggaaatctgcatcttgggtaccaccctcaaggagaggagcttcttccagggaaactgaggctaagaagaaaagctggaaagaagttttgaagttcccaaagagttttaattga

SEQ ID NO: 88 - protein, 567 aa, Saccharomyces cerevisiae
MASEQSSPEINADNLNSSAADVHVQPPGEKEWSDGFYDKEVINGNTPDAPKRGFLGYLIIYLLCYPVSFGGFLPGWDSGITAGFINMDNFKMNFGSYKHSTGEYYLSNVRMGLLVAMFSVGCSIGGVAFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYSNTAQWRIPVGLCFLWALIIIVGMLLVPESPRYLIECERHEEACVSIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAASMMACMVIFASIGVKCLYPHGQDGPSSKGAGNAMIVFTCFYIFCFATTWAPVAYIVVAESFPSKVKSKAMSISTAFNWLWQFLIGFFTPFITGSIHFYYGYVFVGCLVAMFLYVFFFLPETIGLSLEEIQLLYEEGIKPWKSASWVPPSRRGASSRETEAKKKSWKEVLKFPKSFN

SEQ ID NO: 89 - DNA, 1620 bp, Saccharomyces cerevisiae
atgagtaccaataagttcgttgtacgaataacgaatgcgctcttcaagtcatcactggctagcaacagtccacctgtttaccctaagaggattaggcatttcgagattttacccaacgaaaaatgggttatatggggacctggaaagggcaagttcttggatgtactgaataacaagtatatttgtgagcccccattatctttgaggtttggatttttgaaggaaagttcgaacatcctgccgaggatagagcaagtggccttcaaaggggttatgccaacggctcatttaagtgctagatatgaatacttcaaagatgactacgatcaaacctgcaaacagtttatatttgataaggcaagcggatcaaatgctgtttcatataaagttgagacgaacaatcggcaaataaacatggagctgtacaatgcattagttgaaaatttaaacctctccagtttacaggataggtgggtaatgggattgagtaatggacaaatgaggagagcaaggttagctcgtagtatactcaaggaaccggatctactacttattgacgacccatttttagggttggatccagccgcaatagcaaccatttcacaatttttagccaaatatgatagtatagaagtcagtggcggatgtccaatcgtcattggtttgaggtatcaagataccattccagcatggtgtactcatatatgttgcgttgatgagaaaaacggtatattgtttgaaggcccaatcgaaaaacttcaaagtaaaatggatgaaaccagatcaagggcactaaaagaactagagcagctcaaaaaagcgtctaattccaaagaggacatttccattaacgatttgatttgtatacatcctatgtatggcaagaaagagcacgaaattatcaaaatgcctcatcttatagaattagacgggttgagcgtttcatacaaaggcgaagctgttttggaaaatctgcactggaaagttcagccgggttcgaaatggcatataagaggtgacaatgggtcaggtaagtcgaccttattatctttgcttacggcggaacatccccaatcgtggaattcgagggtgatagataatggcgtcccacgaagaacaggtaaaacaaactactttgacctaaacagcaaaataggtatgtcatcacccgaattacacgcaatttttttgaagaatgctggaggaaggctaaacattcgggaaagtgttgcaactggctatcatgaggcgtcctccaacaattacctacccatatggaagcgcttggacaaaaatagccaagaaatagtgaatatgtatctgaaatattttggcctggacaaagacgccgatagtgttttatttgaacagttgtccgtaagtgaccagaaactagtcctttttgtcaggtctttaattaagatgccgcaaatattgattctcgatgaggcattttctggaatggaggtagaacctatgatgcgttgtcatgaatttttagaggagtggcctggaacagtccttgtagtggcacacgttgccgaagagacaccaaaatgtgcccattacttaaggctcatatctcctggagagtatgaaataggcgatatggaaaattaa

SEQ ID NO: 90 - protein, 539 aa, Saccharomyces cerevisiae
MSTNKFVVRITNALFKSSLASNSPPVYPKRIRHFEILPNEKWVIWGPGKGKFLDVLNNKYICEPPLSLRFGFLKESSNILPRIEQVAFKGVMPTAHLSARYEYFKDDYDQTCKQFIFDKASGSNAVSYKVETNNRQINMELYNALVENLNLSSLQDRWVMGLSNGQMRRARLARSILKEPDLLLIDDPFLGLDPAAIATISQFLAKYDSIEVSGGCPIVIGLRYQDTIPAWCTHICCVDEKNGILFEGPIEKLQSKMDETRSRALKELEQLKKASNSKEDISINDLICIHPMYGKKEHEIIKMPHLIELDGLSVSYKGEAVLENLHWKVQPGSKWHIRGDNGSGKSTLLSLLTAEHPQSWNSRVIDNGVPRRTGKTNYFDLNSKIGMSSPELHAIFLKNAGGRLNIRESVATGYHEASSNNYLPIWKRLDKNSQEIVNMYLKYFGLDKDADSVLFEQLSVSDQKLVLFVRSLIKMPQILILDEAFSGMEVEPMMRCHEFLEEWPGTVLVVAHVAEETPKCAHYLRLISPGEYEIGDMEN

SEQ ID NO: 91 - DNA, 4548 bp, Saccharomyces cerevisiae
atggctggtaatcttgtttcatgggcctgcaagctctgtagatctcctgaagggtttggacctatatccttttacggtgactttactcaatgcttcatcgacggtgtgatcctaaatctatcagcaattttcatgataaccttcggtatcagagatttagttaacctttgcaagaaaaaacactctggcatcaaatataggcggaattggattattgtctctaggatggcactagttctgttggagatagcgtttgtttcacttgcgtctttaaatatttctaaagaagaagcggaaaactttaccattgtaagtcaatatgcttctacaatgttatctttatttgttgctttagccttacactggatagaatacgatagatcagttgtagccaatacggtacttttattctattggctttttgaaacattcggtaattttgctaaactaataaatattctaattagacacacctacgaaggcatttggtattccggacaaacgggtttcatactaacgttattccaagtaataacatgtgccagtatcctgttacttgaagctcttccaaagaagccgctaatgccacatcaacacatacatcaaactttaacaagaagaaaaccaaatccatacgatagcgcaaacatattttccaggattaccttctcttggatgtcaggtttgatgaaaactggctatgaaaaatacttagtggaagcagatttatataaattaccgaggaactttagtagtgaagaactctctcaaaaattggagaaaaactgggaaaatgagttgaagcaaaaatcaaatccttcattatcatgggctatatgcagaacttttggatctaaaatgcttttagccgcattctttaaagcaattcatgatgttctagcatttactcaaccacaactactaaggattttaatcaagttcgtcacagactataacagtgagagacaggatgaccattcttctcttcaagggtttgaaaataaccacccacaaaaattacccattgtaagagggtttttgattgcgtttgctatgtttctggtgggctttactcagacatctgtcctgcatcaatatttcctgaatgtcttcaacacaggcatgtatattaagagcgccctaacggctttaatatatcaaaaatccttagtgctatctaatgaggcttctggactttcctctaccggtgacattgtcaatctcatgagtgtggatgttcaaaaattacaagatttaacacaatggctaaatttaatatggtcagggccttttcaaatcattatttgcttatattctctgtataagttgttgggaaattccatgtgggttggcgtgattatactagttattatgatgccattgaactcatttttgatgaggatacaaaagaagttgcaaaaatcccagatgaagtacaaagatgaaaggacccgtgttataagtgaaatactaaacaatattaaatctttgaagttatatgcatgggagaagccttatagggaaaagctagaagaagtaagaaataacaaagagttaaaaaatcttacaaaactaggatgttatatggctgtgacaagttttcagttcaatatagtaccattccttgtttcatgttgtacctttgctgtatttgtttatactgaggatagagcattgactactgacttagttttccctgctttgactctgttcaacctgctctcattcccactaatgattattcctatggttttaaattcttttatcgaagcttctgtttctattggtagattatttacattctttaccaatgaagagctacaaccagattcggttcagcgtttaccaaaagtaaaaaatattggcgatgtagccattaacattggagatgatgctacctttttatggcaacggaaaccggaatacaaagtagccttaaagaatattaatttccaagctaaaaaaggaaatttgacctgtattgttggtaaagttggcagtggtaaaacagctctattgtcatgcatgttaggtgatctattcagggttaaaggtttcgccaccgttcatggttctgttgcttatgtttcacaagttccatggataatgaatggtactgtaaaggaaaacattttatttgggcatagatacgacgcggaattttacgaaaaaacgatcaaggcctgtgcgttaactattgatcttgcaattttgatggatggagataagacattagttggcgagaaagggatctccttatctggaggacaaaaagctcgtttgtctttagcaagagcagtttatgcgagagctgacacttatttacttgatgatcctttggcagctgttgatgaacacgttgccaggcacttgatcgaacatgtgttgggtccaaatggtttattacatacaaaaacgaaggtattagccactaataaggtgagcgcgttatccatcgcagattctattgcattattagataatggagaaatcacacagcagggtacatatgatgagattacgaaggacgctgattcgccattatggaaattgctcaacaactatggtaaaaaaaataacggtaagtcgaatgaattcggtgactcctctgaaagctcagttcgagaaagtagtatacctgtagaaggagagctggaacaactgcagaaattaaatgatttggattttggcaactctgacgccataagtttaaggagggccagtgatgcaactttgggaagcatcgattttggtgacgatgaaaatattgctaaaagagagcatcgtgaacagggaaaagtaaagtggaacatttacctagagtacgctaaagcttgcaacccgaaaagcgtttgtgtattcatattgtttattgttatatcgatgttcctctctgttatgggtaacgtttggttgaaacattggtctgaagttaatagccgctatggatctaatccaaatgccgcgcgttacttggccatttattttgcacttggtattggttcagcactggcaacattaatccagacaatcgttctctgggttttttgtaccattcatgcctccaaatatttacacaacttgatgacaaactctgtgttgagagccccaatgacgttttttgaaacaacaccaatcggtagaattctaaacagattctcaaatgacatatacaaagtggatgctttattaggaagaacattttctcagtttttcgtcaatgcagtgaaagtcacattcactattacggttatctgtgcgacgacatggcaatttatcttcattatcattccactaagtgtgttttacatctactaccagcagtattacctgagaacatcaagggagttgcgtcgtttagactctattactaggtctccaatctactctcatttccaagagactttgggtggccttgcaacggttagaggttattctcaacagaaaaggttttcccacattaatcaatgccgcattgataataacatgagtgcgttctatccctctatcaatgctaaccgttggctagcatataggttggaacttattggttcaattatcattctaggtgctgcaactttatccgtttttagactaaaacaaggcacattaacggcaggtatggtgggtttatcattaagctatgctttacaaatcactcaaacgttaaattggattgttagaatgactgtggaagttgaaacgaatattgtttcagtggaaagaataaaggaatatgctgatttgaagagcgaggcacctttaatagttgaaggccacagaccacccaaagaatggccgagccagggtgatataaagtttaataattattccactcgttataggccggagcttgatcttgttctgaagcacattaatatacacattaaaccaaatgaaaaagttggtatcgtgggtagaacgggtgcgggaaaatcctcattaacgctagcattattcaggatgattgaggctagcgagggaaacatcgtaatcgacaacattgccatcaacgagattgggttatatgatttgagacataaattgtcaatcatacctcaggattctcaagtttttgagggcactgttcgtgagaacattgatcccattaaccaatacactgatgaagctatttggagggcattggaactttctcatttgaaagaacacgtgctatcaatgagcaatgacggattagatgcccaactaaccgaaggtggtggcaacttaagtgttggacaaagacaattattatgtcttgcaagagcaatgttggttccatcaaagattttggtgcttgatgaagccacggccgcagtcgacgtggagacagataaagtcgtccaagagacgattcgtactgctttcaaggacagaactatcttgaccatcgcgcatagactgaacacgataatggacagtgatagaatcatagtgttggacaatggtaaagtagccgagtttgactctccgggccagttattaagtgataacaaatcattgttctattcactgtgcatggaggctggtttggtcaatgaaaattaa

SEQ ID NO: 92 - protein, 1515 aa, Saccharomyces cerevisiae
MAGNLVSWACKLCRSPEGFGPISFYGDFTQCFIDGVILNLSAIFMITFGIRDLVNLCKKKHSGIKYRRNWIIVSRMALVLLEIAFVSLASLNISKEEAENFTIVSQYASTMLSLFVALALHWIEYDRSVVANTVLLFYWLFETFGNFAKLINILIRHTYEGIWYSGQTGFILTLFQVITCASILLLEALPKKPLMPHQHIHQTLTRRKPNPYDSANIFSRITFSWMSGLMKTGYEKYLVEADLYKLPRNFSSEELSQKLEKNWENELKQKSNPSLSWAICRTFGSKMLLAAFFKAIHDVLAFTQPQLLRILIKFVTDYNSERQDDHSSLQGFENNHPQKLPIVRGFLIAFAMFLVGFTQTSVLHQYFLNVFNTGMYIKSALTALIYQKSLVLSNEASGLSSTGDIVNLMSVDVQKLQDLTQWLNLIWSGPFQIIICLYSLYKLLGNSMWVGVIILVIMMPLNSFLMRIQKKLQKSQMKYKDERTRVISEILNNIKSLKLYAWEKPYREKLEEVRNNKELKNLTKLGCYMAVTSFQFNIVPFLVSCCTFAVFVYTEDRALTTDLVFPALTLFNLLSFPLMIIPMVLNSFIEASVSIGRLFTFFTNEELQPDSVQRLPKVKNIGDVAINIGDDATFLWQRKPEYKVALKNINFQAKKGNLTCIVGKVGSGKTALLSCMLGDLFRVKGFATVHGSVAYVSQVPWIMNGTVKENILFGHRYDAEFYEKTIKACALTIDLAILMDGDKTLVGEKGISLSGGQKARLSLARAVYARADTYLLDDPLAAVDEHVARHLIEHVLGPNGLLHTKTKVLATNKVSALSIADSIALLDNGEITQQGTYDEITKDADSPLWKLLNNYGKKNNGKSNEFGDSSESSVRESSIPVEGELEQLQKLNDLDFGNSDAISLRRASDATLGSIDFGDDENIAKREHREQGKVKWNIYLEYAKACNPKSVCVFILFIVISMFLSVMGNVWLKHWSEVNSRYGSNPNAARYLAIYFALGIGSALATLIQTIVLWVFCTIHASKYLHNLMTNSVLRAPMTFFETTPIGRILNRFSNDIYKVDALLGRTFSQFFVNAVKVTFTITVICATTWQFIFIIIPLSVFYIYYQQYYLRTSRELRRLDSITRSPIYSHFQETLGGLATVRGYSQQKRFSHINQCRIDNNMSAFYPSINANRWLAYRLELIGSIIILGAATLSVFRLKQGTLTAGMVGLSLSYALQITQTLNWIVRMTVEVETNIVSVERIKEYADLKSEAPLIVEGHRPPKEWPSQGDIKFNNYSTRYRPELDLVLKHINIHIKPNEKVGIVGRTGAGKSSLTLALFRMIEASEGNIVIDNIAINEIGLYDLRHKLSIIPQDSQVFEGTVRENIDPINQYTDEAIWRALELSHLKEHVLSMSNDGLDAQLTEGGGNLSVGQRQLLCLARAMLVPSKILVLDEATAAVDVETDKVVQETIRTAFKDRTILTIAHRLNTIMDSDRIIVLDNGKVAEFDSPGQLLSDNKSLFYSLCMEAGLVNEN

SEQ ID NO: 93 - DNA, 1992 bp, Saccharomyces cerevisiae
atgacgcttggtaatagacgccatgggcggaataatgagggaagctctaatatgaatatgaatcgtaacgaccttgacgatgtttcccattacgagatgaaggaaatacaaccaaaggaaaaacaaattggctctatagaaccggaaaatgaagtagaatattttgaaaaaacagtggaaaaaaccattgaaaatatggaatatgaaggtgaacatcatgcatcttacttacggaggttcattgactcgtttagaagagcggaaggctcgcatgcaaattccccagactcgagcaactctaatgggactactcctatatccacaaaagattccagctctcaattggacaatgagttgaatcggaagagctcatacatcactgttgatggtattaaacagtcaccacaagaacaagaacagaaacaagaaaatttgaaaaagagtataaagccccgtcatacggtgatgatgtccctagggactggtattggtactggtttgctggtcggtaactccaaagttttgaacaatgcaggtccgggtggtttgatcattggttatgctattatgggtagttgtgtttactgtattattcaagcttgtggtgaattagcggttatatacagtgatttgattggtggatttaatacatatcctttgtttttggtcgaccctgcacttggcttttctgttgcttggcttttttgcttacaatggctatgtgtttgtcctctagaattggtcactgcatccatgactatcaaatattggacgacatctgtgaacccggatgttttcgttgttatcttctacgtactaatcgttgttatcaacgtttttggagctaagggttatgcagaggcagatttcttcttcaattgttgtaaaattctgatgatagttggatttttcattctcgccattattattgattgtggtggtgcaggtaccgatggttacataggtagcaaatattggcgtgatcccggagccttccgtggtgatacacccatccagaggttcaaaggtgtcgttgccacatttgtcacagcagcgttcgcctttggtatgagtgaacagctggctatgactgccagtgaacaatccaatccaagaaaggctattccatcggcggcaaagaaaatgatttatagaattctgtttgtgttcttggcgtctttaacgttagttggtttccttgtaccttacacctcagatcaattgctaggggccgcaggttcagccactaaagcgtcgccctacgtcatcgctgtctcctctcatggtgttcgtgtggttcctcatttcataaacgctgtcatcctgttgtctgttctttccgttgctaacggtgccttctataccagttctcgtattttgatgtcgttggccaaacaaggtaatgcacccaaatgtttcgattacatcgatagggaaggtagacctgctgctgctatgcttgtcagtgcattatttggtgtcattgcattctgtgcctcatctaaaaaggaagaggacgttttcacctggttgttagcaatctccggtttgtctcaattattcacgtggattaccatttgtttgtctcacattaggtttagaagagctatgaaagtgcaaggaaggtccttaggagaggttggttataaatctcaagtcggtgtctgggggtcggcttacgctgtccttatgatggtgttagctttaatcgcccaattttgggttgccattgccccaattggtggaggaggtaagttaagtgcccaatcattttttgagaattatttggctatgccaatctggattgctttatacatcttttacaaagtttggaaaaaagattggagtttattcattcccgctgataaagtagacttagtttctcatagaaacatctttgatgaagaattattaaaacaagaagatgaagaatataaagagagattaagaaacggaccatactggaaaagagttcttgatttctggtgttaa

SEQ ID NO: 94 - protein, 663 aa, Saccharomyces cerevisiae
MTLGNRRHGRNNEGSSNMNMNRNDLDDVSHYEMKEIQPKEKQIGSIEPENEVEYFEKTVEKTIENMEYEGEHHASYLRRFIDSFRRAEGSHANSPDSSNSNGTTPISTKDSSSQLDNELNRKSSYITVDGIKQSPQEQEQKQENLKKSIKPRHTVMMSLGTGIGTGLLVGNSKVLNNAGPGGLIIGYAIMGSCVYCIIQACGELAVIYSDLIGGFNTYPLFLVDPALGFSVAWLFCLQWLCVCPLELVTASMTIKYWTTSVNPDVFVVIFYVLIVVINVFGAKGYAEADFFFNCCKILMIVGFFILAIIIDCGGAGTDGYIGSKYWRDPGAFRGDTPIQRFKGVVATFVTAAFAFGMSEQLAMTASEQSNPRKAIPSAAKKMIYRILFVFLASLTLVGFLVPYTSDQLLGAAGSATKASPYVIAVSSHGVRVVPHFINAVILLSVLSVANGAFYTSSRILMSLAKQGNAPKCFDYIDREGRPAAAMLVSALFGVIAFCASSKKEEDVFTWLLAISGLSQLFTWITICLSHIRFRRAMKVQGRSLGEVGYKSQVGVWGSAYAVLMMVLALIAQFWVAIAPIGGGGKLSAQSFFENYLAMPIWIALYIFYKVWKKDWSLFIPADKVDLVSHRNIFDEELLKQEDEEYKERLRNGPYWKRVLDFWC

SEQ ID NO: 95 - DNA, 1008 bp, Saccharomyces cerevisiae
atgaataatggagacaataaaacgacattagaaaactcaaaaaatgcgtcactagctaatggaaattatgcgattcccacaaaactaaataggctgaaaaagaatgctgaccctagagttgctgcaatttcaggtgctttatctggtgcactatccgcaatgctggtctgtccttttgacgttgcgaaaacaagattacaagcacaaggtctccaaaacatgacacaccaaagtcaacattataaggggttttttggtacatttgctactattttcaaggatgaaggtgctgctgggctttataaaggtctacagccgacggttttaggttatattcctactttgatgatttacttttccgtctatgatttctgtagaaaatattcggtcgatattttcccacatagtccgtttctctcaaacgcttcttctgcaattactgcaggtgccatctctacagttgcgacaaatccgatttgggtagtaaaaacaagacttatgctgcaaacaggtatcggtaaatattccacccattataagggtaccatagacacatttagaaagatcattcaacaagagggtgctaaggctctttatgccggcttagtaccagccctgctggggatgctgaacgttgctatacagtttcctttatatgaaaatttaaaaataaggttcggatattcagaatcgactgacgtatcgacagatgtgacgagctcaaactttcaaaaattaatattggcctctatgctatctaaaatggtagcatctaccgtgacttatcctcacgaaatacttcgaactcgaatgcaactgaaatccgatcttccaaatactgttcaacgccatctccttccattgattaaaattacgtataggcaagagggcttcgccggcttttactctgggtttgcaactaatttggtaaggacagtacctgctgctgtggtaacactagtatcgtttgaatattctaaaaagtatttaactactttttttcaataa

SEQ ID NO: 96 - protein, 335 aa, Saccharomyces cerevisiae
MNNGDNKTTLENSKNASLANGNYAIPTKLNRLKKNADPRVAAISGALSGALSAMLVCPFDVAKTRLQAQGLQNMTHQSQHYKGFFGTFATIFKDEGAAGLYKGLQPTVLGYIPTLMIYFSVYDFCRKYSVDIFPHSPFLSNASSAITAGAISTVATNPIWVVKTRLMLQTGIGKYSTHYKGTIDTFRKIIQQEGAKALYAGLVPALLGMLNVAIQFPLYENLKIRFGYSESTDVSTDVTSSNFQKLILASMLSKMVASTVTYPHEILRTRMQLKSDLPNTVQRHLLPLIKITYRQEGFAGFYSGFATNLVRTVPAAVVTLVSFEYSKKYLTTFFQ

SEQ ID NO: 97 - DNA, 870 bp, Saccharomyces cerevisiae
atggtttcccaatttgctattgaggtgcgtaacctaacgtacaaattcaaagaaagctccgatccgtcagttgttgatatcaatcttcaaatcccatggaatacaagatctttagttgtgggtgccaatggtgctggtaaatccacccttttgaaattactaagcggtaagcatctttgccttgatggaaaaatcctggtcaatggtcttgatccattcagtccattatctatgaatcaagtggacgatgatgaaagtgttgaagattcgacgaactaccaaacgaccacttatctaggtacggaatggtgccatatgagtatcattaatagggatatcggcgtcttggaactattaaaaagtattggattcgatcattttagggaaagaggtgaaagattggttagaatcctggacatcgatgtacgttggagaatgcacaggttaagtgatggacaaaagagaagagttcagttagccatggggctcttgaaaccttggagagttttactacttgatgaggtcactgtggatctcgatgttattgccagagcaagacttctggagtttttaaagtgggagaccgaaaccagaagatgctcagtggtctacgctacacatatttttgacggcttggccaaatggcctaaccaagtataccatatgaaatcaggtaagattgtggataatttagattatcagaaagacgtagagttctctgaagtggtcaatgctaaagttaatggacaagtggcctttgaaaatgacaacaataaggttgttattagtaaagtgaatagtttgcatccattagcactagaatggttgaaacgtgataatcaaattcctgacaaagagattggtatataa

SEQ ID NO: 98 - protein, 289 aa, Saccharomyces cerevisiae
MVSQFAIEVRNLTYKFKESSDPSVVDINLQIPWNTRSLVVGANGAGKSTLLKLLSGKHLCLDGKILVNGLDPFSPLSMNQVDDDESVEDSTNYQTTTYLGTEWCHMSIINRDIGVLELLKSIGFDHFRERGERLVRILDIDVRWRMHRLSDGQKRRVQLAMGLLKPWRVLLLDEVTVDLDVIARARLLEFLKWETETRRCSVVYATHIFDGLAKWPNQVYHMKSGKIVDNLDYQKDVEFSEVVNAKVNGQVAFENDNNKVVISKVNSLHPLALEWLKRDNQIPDKEIGI

SEQ ID NO: 99 - DNA, 3522 bp, Saccharomyces cerevisiae
atgtctagacaagacgaaaattctgctttactagcgaataatgaaaataacaaaccatcgtatacgggaaatgagaacggagtctacgataatttcaaattatcaaaaagtcaactttcggatcttcataaccctaaatcaataagatcatttgtcagattatttggatatgagtctaacagcctcttcaaatacttgaaaacagataaaaatgcaggcatttctcttccagaaatatcaaattatcgaaagacaaaccggtataaaaattatggcgataattcacttcctgaaagaataccaaagtcttttttacaattagtatgggctgcttttaatgacaaaacaatgcaattactgacagtcgccgctgttgtttcctttgttttaggtctatacgaactatggatgcaacctccacagtatgatcctgaaggaaataaaattaagcaagttgactggattgaaggggttgctatcatgattgcggtctttgtggtagttctagtgagtgccgctaacgattaccagaaggagttgcaatttgcaaagctaaataaaaagaaggaaaaccgtaaaattatagtcataagaaatgatcaggaaatattaatttccattcaccacgttttagtcggtgatgtcatttcattacaaaccggtgatgttgtccccgctgattgtgttatgatatcagggaagtgtgaggcagatgaatcatccatcactggtgaatctaacacaatacagaaatttccggtggataactcattaagagatttcaaaaaatttaattctatcgatagtcataaccatagcaaaccattagatataggtgacgttaacgaagacggtaacaagattgctgattgtatgttgatttcaggttccagaattctctctggcttgggcaggggtgtcatcacgtccgtgggtataaactcagtttacggtcaaaccatgacttcattaaatgccgaacctgaaagtactccattacagttacatttgagccaattggctgataatatatccgtttacggttgcgtgtctgctataattcttttcttggtccttttcactaggtacttattttacataatacctgaggatggcaggttccatgatctagatcccgctcaaaagggttctaaatttatgaacatttttatcacatctatcacggttattgtggtggctgttccggaaggtttaccattagctgtaactttggccttagcgtttgcaacaacaagaatgacaaaagacggtaatttagtacgggttttaagaagctgtgaaacgatgggatctgctactgcagtgtgctctgataagactggcactttgacagaaaatgtcatgactgtcgttcgtggcttcccgggcaattctaaatttgatgatagtaaatcgttgcccgttagcgaacaaaggaagctgaattctaagaaagtttttgaagaaaattgttcgtcatccttgagaaatgatttattagccaatattgtcctgaattctaccgccttcgaaaacagagattataagaaaaacgataaaaatacaaatggtagtaaaaatatgtcaaaaaatttgagttttttagataagtgtaaatctagattatcgttttttaaaaaaggcaacagggaagatgacgaggatcaattattcaaaaatgtcaacaagggtaggcaagaaccctttattggctctaaaacggaaacagccttactcagtttggcaagattatcattaggattacaaccgggagaattgcaatatttgagagatcaaccgatggaaaagtttaatatcgaaaaagttgttcaaacaattccgtttgaaagttctcgtaaatgggccggcttagtggtaaagtacaaagaaggcaaaaataaaaaaccattttacaggtttttcattaaaggtgcagcagaaattgtttccaagaattgttcgtacaagaggaattcagatgatactttggaagaaatcaatgaggacaataaaaaagaaactgatgatgaaatcaaaaatcttgcgtccgatgctctcagagccataagtgttgcccacaaagatttctgcgaatgtgatagctggccccctgaacagctgcgtgataaagactcaccaaatatagctgctcttgacttgctatttaacagtcaaaagggcttaattctagatggtttacttgggattcaagaccctttacgtgcaggcgttagggagtcagtacaacagtgccaacgtgctggtgtaactgtgcgtatggttactggtgacaatatattaacagcaaaagcaatcgcgaggaattgtgcgattctttctactgatattagttcagaggcttattctgcaatggaaggcactgaattcagaaagttaacgaaaaacgaacgtataagaatcctgccaaatttaagggtcttagcaaggtcttcgcctgaggataaaaggttattagtagaaacattgaaggggatgggagatgttgttgcggtcactggcgatggtacgaacgatgctccagctttaaagctagctgatgttggtttctcaatgggtatttccggtacggaggttgccagagaggcttctgacattattttgatgactgatgatttctcagctattgtcaacgctattaagtggggaagatgtgtttcagtctccataaaaaagttcatacagtttcaattaattgttaatatcaccgcagtgattttaacgttcgtttcatccgttgcatctagtgatgaaacatcagtactgacggcggtccaactgttatggatcaatctaatcatggatactctagcagctttagctttagccactgataaacccgatccaaatatcatggacagaaaacctaggggccgctcaacttctttgatttctgtgtcaacttggaaaatgattctatcacaagctacattgcagttgatagttactttcattttgcatttttacgggccagagttattcttcaagaaacatgaagatgaaataacaagtcaccaacagcagcaactgaatgccatgacattcaacacttttgtttggttgcaattttttaccatgttagtatcgagaaaattagatgaaggtgatggtatatcaaactggagaggcaggatttctgccgccaatttgaatttcttccaagacttgggtagaaactattattttctcacgatcatggcgatcattggcagctgtcaagttttaatcatgttttttggtggcgcaccattttctattgccagacaaaccaaatcaatgtggataaccgcggtactgtgtggtatgttgtctctaatcatgggggtgctagtgagaatctgccccgatgaagtagcagtgaaggtatttccggctgctttcgttcaaagattcaagtacgtatttggactcgagttcctcagaaaaaaccatactggaaaacacgacgatgaagaagcgctgttggaggaatctgatagtccagagtccaccgccttttattaa

SEQ ID NO: 100 - protein, 1173 aa, Saccharomyces cerevisiae
MSRQDENSALLANNENNKPSYTGNENGVYDNFKLSKSQLSDLHNPKSIRSFVRLFGYESNSLFKYLKTDKNAGISLPEISNYRKTNRYKNYGDNSLPERIPKSFLQLVWAAFNDKTMQLLTVAAVVSFVLGLYELWMQPPQYDPEGNKIKQVDWIEGVAIMIAVFVVVLVSAANDYQKELQFAKLNKKKENRKIIVIRNDQEILISIHHVLVGDVISLQTGDVVPADCVMISGKCEADESSITGESNTIQKFPVDNSLRDFKKFNSIDSHNHSKPLDIGDVNEDGNKIADCMLISGSRILSGLGRGVITSVGINSVYGQTMTSLNAEPESTPLQLHLSQLADNISVYGCVSAIILFLVLFTRYLFYIIPEDGRFHDLDPAQKGSKFMNIFITSITVIVVAVPEGLPLAVTLALAFATTRMTKDGNLVRVLRSCETMGSATAVCSDKTGTLTENVMTVVRGFPGNSKFDDSKSLPVSEQRKLNSKKVFEENCSSSLRNDLLANIVLNSTAFENRDYKKNDKNTNGSKNMSKNLSFLDKCKSRLSFFKKGNREDDEDQLFKNVNKGRQEPFIGSKTETALLSLARLSLGLQPGELQYLRDQPMEKFNIEKVVQTIPFESSRKWAGLVVKYKEGKNKKPFYRFFIKGAAEIVSKNCSYKRNSDDTLEEINEDNKKETDDEIKNLASDALRAISVAHKDFCECDSWPPEQLRDKDSPNIAALDLLFNSQKGLILDGLLGIQDPLRAGVRESVQQCQRAGVTVRMVTGDNILTAKAIARNCAILSTDISSEAYSAMEGTEFRKLTKNERIRILPNLRVLARSSPEDKRLLVETLKGMGDVVAVTGDGTNDAPALKLADVGFSMGISGTEVAREASDIILMTDDFSAIVNAIKWGRCVSVSIKKFIQFQLIVNITAVILTFVSSVASSDETSVLTAVQLLWINLIMDTLAALALATDKPDPNIMDRKPRGRSTSLISVSTWKMILSQATLQLIVTFILHFYGPELFFKKHEDEITSHQQQQLNAMTFNTFVWLQFFTMLVSRKLDEGDGISNWRGRISAANLNFFQDLGRNYYFLTIMAIIGSCQVLIMFFGGAPFSIARQTKSMWITAVLCGMLSLIMGVLVRICPDEVAVKVFPAAFVQRFKYVFGLEFLRKNHTGKHDDEEALLEESDSPESTAFY

SEQ ID NO: 101 - DNA, 2178 bp, Saccharomyces cerevisiae
atgcctcaatctactccaagtcaagaagtacagcgtgtaccatgggataataaacctgctttgaagcagataacactccgagcaaccatagcaggtatcgctatagggtctctggtgctaacatcaaattttcaatttggcctgcaaaccggttgggtttccatgatgtccctgccatcggcattgttagcttgtgctttctttaaaaatatctggccattaatatttccgaacgacaggcctttcagtgacgttgaaaatgtatacgtacaaagtatggcagtagctgtcggaacaggcccattagcctttgggtttgtcggcgtcatacctgccatcgagaagttccttactaacgacgaaagtggtggattaagggaacaaggacagtccttcacttttagagaattgttaatatggtccacagccctagcattcttcggtattttttttgcagttcctctaagaaagcaagtaattgttagagagaaacttcccttccccagtggtagcgccacggccactttaatttcagtgctaaatggaactgagattttacaagaggtttctaagtcagagttattggaaatgaggcagaggagattgaatgaatgccctgaagtgctacaacccaacagagatccagaggaggcggattatttaatgaactcttctcatagcgaacttggtgattatacggcaactagccaagatggaagttctatcctttctactggctctgagaactacagagcgaatattattattttattgaaaacttttgttgtttcttcgctttacaccatggtgtcatattttgtaccggtaatacggtctattccagtcttcggaaaatacctctcgaacaattatctctggaattttcagccgtcgcctgcgtatataggccaagggataataatgggtcttccaacagtatcgtatatgcttatcgggtgcttcttaggctggggtgtgttagcaccattggcgagatacaaaagatgggtaccaccagatgctgatgtccacgactgggaggagggagtgcaaggatggattctttggtcgtcgctttcaataatggttgctgacagtgtagtcgcttttattgttgtgacagtgaagtccattgtgaaatttattcttatagatgacaaagctgctttactgaacaacataatcgatgatacatttcaatctatgttactggaggaggaacgcgccattaatagcagcagaagaaatacatatgttgatggaaggcaggacaccgtaagattagtgagtagagataacgaaatagaagtagattcgaagcatttggttcgctataccaccgttatcagtggatgtctagtctcctcgataatatgcattgtttccataatatatttgtttgggatacaagtaattcccctatatgctattatcactgctttgatacttgcgttgtttctatctattctcggtattcgagcacttggagagaccgatctgaatcctgtgagcggcattggtaagatctctcaattgatttttgcctttatcataccaagggatagacctggatcagtgttaatgaacgtggtatcgggaggtattgcagaagcctctgcccaacaggcgggcgatttaatgcaggatttgaaaacggggcacctcctcggcgcctccccaagagctcagttctgtgcccaattgataggggcctgttggtcaattattttgtctagcttcatgtatttgtgctacaataaagtttattcaattccgagtgagcaattcaggataccgacagcagtagtgtggatagattgtgcaagactagtaactggtaaagggctccctgataaggccttggagtgctccatgattctcggagtcatatttgccgttttatcattaatcagaaacacttatagagattacggatacgggtggatattatatattccgtctggtgtagcagtcggtgttggtatatttaattctcccagttttacaattgcaagattcatcggcgggtgggcttcgcatttttggttgaagaatcataggggtgacttaaatgcgaaaacaaaaatgattgtattcagttcggggttggtcttaggtgaaggtatctttagcgtaataaacatgctcttcatctgcttaaatgtccctcactattag

SEQ ID NO: 102 - protein, 725 aa, Saccharomyces cerevisiae
MPQSTPSQEVQRVPWDNKPALKQITLRATIAGIAIGSLVLTSNFQFGLQTGWVSMMSLPSALLACAFFKNIWPLIFPNDRPFSDVENVYVQSMAVAVGTGPLAFGFVGVIPAIEKFLTNDESGGLREQGQSFTFRELLIWSTALAFFGIFFAVPLRKQVIVREKLPFPSGSATATLISVLNGTEILQEVSKSELLEMRQRRLNECPEVLQPNRDPEEADYLMNSSHSELGDYTATSQDGSSILSTGSENYRANIIILLKTFVVSSLYTMVSYFVPVIRSIPVFGKYLSNNYLWNFQPSPAYIGQGIIMGLPTVSYMLIGCFLGWGVLAPLARYKRWVPPDADVHDWEEGVQGWILWSSLSIMVADSVVAFIVVTVKSIVKFILIDDKAALLNNIIDDTFQSMLLEEERAINSSRRNTYVDGRQDTVRLVSRDNEIEVDSKHLVRYTTVISGCLVSSIICIVSIIYLFGIQVIPLYAIITALILALFLSILGIRALGETDLNPVSGIGKISQLIFAFIIPRDRPGSVLMNVVSGGIAEASAQQAGDLMQDLKTGHLLGASPRAQFCAQLIGACWSIILSSFMYLCYNKVYSIPSEQFRIPTAVVWIDCARLVTGKGLPDKALECSMILGVIFAVLSLIRNTYRDYGYGWILYIPSGVAVGVGIFNSPSFTIARFIGGWASHFWLKNHRGDLNAKTKMIVFSSGLVLGEGIFSVINMLFICLNVPHY

SEQ ID NO: 103 - DNA, 3111 bp, Saccharomyces cerevisiae
atgggaaggactattaggagacgccggagtaattcgtcgctttcggaggccatatcagtttctttaggaataaatcaagactcatctgtgaacaagatgcatagagcgagtgttagcgcaatgtctcctccattatgccgttcatacatgagcggattttttactggtggaaactcacctatgatcaataatttgtcggattcaaaacttcccatctcgaacaaacaacatcctaaagtgatacatggatcagaaaatttgcataggcagacagctcaactatccaatgaattttgctcctcttctgtggaagaaaattctcccacaattaaggattacatggacattataggcaatggtgatagaaaagatgatcaatctatgcgtactatagaagagaatattgatgaagaatattcagatgagtactccagattgctacttagcccagcatcgtctaacgtggacgatgaccgaaatcgaggactacagaatagttcactaccggaattagaagatggttacgcgggcggatatcagtcacttcgtccctcccataatttaaggtttaggccaagaaacttgtggcatatgtgtacgtcatttccttccaaatttgcacattatctgcccgcagcagtgttaggtttgcttttgaacattttagatgccttatcttatggtatgatcatttttccaatcacagagccagttttttctcatttagggcccactggtatatccatgttttatatttccaccataatatcacaagccgtgtactccggaggctggtcgagttttccttccgggattgggagtgaaatgattgaaattactccgttttatcatacaatggcattagctataaaagaggcattagcaggtaatgatgacgaaatcataacgacaacgatattttgttatgtgataagttcgatgctcacaggtgtcgttttctatgcattgggtaaactacgactaggaaagatagtgggattttttccacgacacatattgattggctgtattggaggtgttggttatttcttgataattacaggaattgaagtcacaacgagggtggcgaaatttgaatattcatggccttttttttcagggctgtttacggattatgacacattagcgaaatggttattacctgtactattgactgtagttttaatcggcactcaacgctactttaagaactcactcgttttgccaagtttttacatcttgacgttagttttgtttcattttattgttgcgatcattccaacattatccttggatgctttgagacaagctggatggatttttcctattgccaactcagatagtaaatggtatgaccattatagattatttaatgtccataaagttcattggtcactagttttgcaacaaataccaacgatgatggcattgacattttttggtatcctacatgttcctataaatgttcctgcgttggctatgtcactacaaatggataagtatgatgttgacagagaattgattgcacatggttattccaacttttttagtggattattaggttctgtccaaaattacttggtatataccaacagtgttctgtttattagggcgggcgctgattcgccattcgctgggttccttttaatagctttgactatctgtattatgatcattggaccagtcataatatcattcattccaatctgtatagtgggctctctaattttcctactaggctacgagttattagtggaagcgttggtcgatacatggaataaattgaatagattcgaatatttgactgttgtcattattgttttcacgatgggtatctttgattttgtcctaggtatcatcgttggcattttaattgcatgtttttcgtttttggtggatagtacgaaattacaaaccattaacggtgaatataatgggaacgtcgcaagaagtacagtatatcgtgattacgttcaaacaaaatttttggatggaattggtgaacaaatatatgttttaaagctccaaaaccttctgtttttcggaacaatcatatctattgaagagaaaattgaaagattgctgcaaataagtaacaaagatgcaacaaaacgcagaataaagtatttaatattggactttaaaaatattaatgccgacaatattgactattctgcggcagaaggtttcaatagaattaaaagattcacggaaaccaaaagaatcaaactaatcatatcttcaatcaaagaaagggaccgtatttacaacgccttcaataatgtgggattactaaacgatgtggaattatttgctgatttaaacagtgcgttggaatggtgtgaaaacgaattcctttttcaatataaacaattaagaaaaaaggcgaaagaaagattggaagaaggaaagcaaaataatgtcgtatccgcagtaattgcagccactaaaaacaaaaaaattgatacaataggaaatggtttaaacaggggaagcaatggagacacagcgagaaacttaatgtcactaccaaccaatactcctcgtaattaccaaatactttctgtagcacagaatgtatttgtaaacgacgaacaagcagtgaagaatttcaaaaaggagtacaaagatgatgaacctgtcctgcctatattgttatttgcattaaagcagtaccgacccgatataatatctgaagttcaaaaagtaagagaaaaggaaatcaagttttgggcacaactctgcccctacttcaccaggcgcagattagcaagtcaatcacatttactacatgcagacaacatttttttccttgtggaaacaggtatgttgaaggcaacatatgaactaccacaaggaaccttgtacgagattttttcaaatggcacatgcttcggaaaaatcattgcgccagggaatgctatgcctagagaacaaaagctcaccatcgaaactgaaactgattccgtattatgggttatagactctagctcgttgaacaaattgaaagaagacaatctagcattgtacgtggaggttgcattaatggtcatgtgtatcaaggacaccagattcaaagaattactaggttacacacttgttagcgcatga

SEQ ID NO: 104 - protein, 1036 aa, Saccharomyces cerevisiae
MGRTIRRRRSNSSLSEAISVSLGINQDSSVNKMHRASVSAMSPPLCRSYMSGFFTGGNSPMINNLSDSKLPISNKQHPKVIHGSENLHRQTAQLSNEFCSSSVEENSPTIKDYMDIIGNGDRKDDQSMRTIEENIDEEYSDEYSRLLLSPASSNVDDDRNRGLQNSSLPELEDGYAGGYQSLRPSHNLRFRPRNLWHMCTSFPSKFAHYLPAAVLGLLLNILDALSYGMIIFPITEPVFSHLGPTGISMFYISTIISQAVYSGGWSSFPSGIGSEMIEITPFYHTMALAIKEALAGNDDEIITTTIFCYVISSMLTGVVFYALGKLRLGKIVGFFPRHILIGCIGGVGYFLIITGIEVTTRVAKFEYSWPFFSGLFTDYDTLAKWLLPVLLTVVLIGTQRYFKNSLVLPSFYILTLVLFHFIVAIIPTLSLDALRQAGWIFPIANSDSKWYDHYRLFNVHKVHWSLVLQQIPTMMALTFFGILHVPINVPALAMSLQMDKYDVDRELIAHGYSNFFSGLLGSVQNYLVYTNSVLFIRAGADSPFAGFLLIALTICIMIIGPVIISFIPICIVGSLIFLLGYELLVEALVDTWNKLNRFEYLTVVIIVFTMGIFDFVLGIIVGILIACFSFLVDSTKLQTINGEYNGNVARSTVYRDYVQTKFLDGIGEQIYVLKLQNLLFFGTIISIEEKIERLLQISNKDATKRRIKYLILDFKNINADNIDYSAAEGFNRIKRFTETKRIKLIISSIKERDRIYNAFNNVGLLNDVELFADLNSALEWCENEFLFQYKQLRKKAKERLEEGKQNNVVSAVIAATKNKKIDTIGNGLNRGSNGDTARNLMSLPTNTPRNYQILSVAQNVFVNDEQAVKNFKKEYKDDEPVLPILLFALKQYRPDIISEVQKVREKEIKFWAQLCPYFTRRRLASQSHLLHADNIFFLVETGMLKATYELPQGTLYEIFSNGTCFGKIIAPGNAMPREQKLTIETETDSVLWVIDSSSLNKLKEDNLALYVEVALMVMCIKDTRFKELLGYTLVSA

SEQ ID NO: 105 - DNA, 318 bp, Saccharomyces cerevisiae
atgggtctatcatctatctttggcggcggtgcaccatcacaacaaaaggaagcagccactactgcaaagacaaccccaaaccctatagccaaggagctgaaaaaccaaattgctcaagaactggctgtggctaatgcgactgaattagtgaacaaaatttctgagaactgctttgaaaaatgcttaacttcgccatacgctaccagaaacgatgcgtgcattgaccagtgtttggctaaatatatgagaagttggaatgtcatatcaaaggcttacatctccagaatccagaacgcctccgcttctggcgaaatctaa

SEQ ID NO: 106 - protein, 105 aa, Saccharomyces cerevisiae
MGLSSIFGGGAPSQQKEAATTAKTTPNPIAKELKNQIAQELAVANATELVNKISENCFEKCLTSPYATRNDACIDQCLAKYMRSWNVISKAYISRIQNASASGEI

SEQ ID NO: 107 - DNA, 1473 bp, Saccharomyces cerevisiae
atggaggctacatcaagtgctctttcgtctacggcgaatctcgttaagacaatagttggcgctggtacacttgccattccgtacagttttaaaagcgatggtgttctggtaggggttattcttacattattggcggcggtaacatccggtctgggtctctttgtgctatcgaaatgttccaagaccttaattaatccaagaaactcttctttcttcacattatgcatgctcacctatcccactttggccccaatttttgatttggcaatgatagttcaatgctttggtgtgggcttaagttacttagttcttattggtgatctctttccaggactgtttggtggtgaaagaaattattggataattgcatcagctgtaatcatcattcccctatgtttagtgaagaaactagatcaattgaagtattctagtattctaggtcttttcgcgctagcatacatatcaattctggtgttcagtcattttgtgtttgagctgggaaagggtgaattaacaaatatattaagaaatgacatatgctggtggaaaattcacgactttaaaggattattatcaacttttagcattataatttttgcttttacgggatcaatgaacctattccccatgataaatgaattaaaagacaacagcatggaaaatatcactttcgttatcaataattcgatatccttatcaacagcactatttttgatcgttggtttatcaggatatttaaccttcggtaatgaaaccttgggtaatttaatgttgaactacgatcctaactcaatttggatagtaattggcaaattctgtcttggctcaatgttaattctttccttcccgcttctctttcatccgctgcgcatagcagttaacaatgtcatcatctggattgagatcacttatggtggggcaaatcccgaagaggacccacaagtttcggaatacactcgtgcttccaacctaagaccaattagcatgactgtggaagatccagcccagcccagtgatgcactagacgcaacttcttataacgagcaagaatgtttactacctaacgggaactttgataatggttcaattgaaagtcaagagaacaataatgatgaaagagggactatggcggtcgccggggataacgagcatcatgcgccatttgttaagtctagattttactggattactgcattattactaataagcatgtataccttggcgttgtctgtccagtcatttgcactggttctttcatttgtaggggctacaggttcaacgtctatttcattcactttacctggattattaggttacaaattaataggcttggattctttggctattgggaagatgattccaccaaaagatagattttacaaaaggtgcagcttattgctagtcttctacggactatctgtgatgtttttgtcattgtatgtaactgtattcaaccgttcagatgaagcctaa

SEQ ID NO: 108 - protein, 490 aa, Saccharomyces cerevisiae
MEATSSALSSTANLVKTIVGAGTLAIPYSFKSDGVLVGVILTLLAAVTSGLGLFVLSKCSKTLINPRNSSFFTLCMLTYPTLAPIFDLAMIVQCFGVGLSYLVLIGDLFPGLFGGERNYWIIASAVIIIPLCLVKKLDQLKYSSILGLFALAYISILVFSHFVFELGKGELTNILRNDICWWKIHDFKGLLSTFSIIIFAFTGSMNLFPMINELKDNSMENITFVINNSISLSTALFLIVGLSGYLTFGNETLGNLMLNYDPNSIWIVIGKFCLGSMLILSFPLLFHPLRIAVNNVIIWIEITYGGANPEEDPQVSEYTRASNLRPISMTVEDPAQPSDALDATSYNEQECLLPNGNFDNGSIESQENNNDERGTMAVAGDNEHHAPFVKSRFYWITALLLISMYTLALSVQSFALVLSFVGATGSTSISFTLPGLLGYKLIGLDSLAIGKMIPPKDRFYKRCSLLLVFYGLSVMFLSLYVTVFNRSDEA

SEQ ID NO: 109 - DNA, 1347 bp, Saccharomyces cerevisiae
atggcaccggaaatttttgttaaattcaagtgtgcaagtagagacataaagctactatgggcgtccgtctttcttagacttctatcatatggtttaacaaatcaagttttgacgctttttttaaatgccatcaatatgacagaggataaaattgggctgtttatgtcattaacactggcaggggatgtaatttgctcttacattcttacttggtatgcggattcctggggccgaagaagagtcctagtttatggttgtgcaatgatgttgttaagtgggttggttttcagttttagcgaaaatttcaccctcttgctagtatttgctatcttcggtgttatatcgccttcaagtgatgaagtcgggcctttcaaatctatagaagaggccatgattgcacatctgagtcctcataatgcaagaccagagatttatgctattcacgccttggttggaacaattggaagcgctctaggtgcaataatttgtggtatatttgtagatcttttgaaaagaactggtttagctgctactgatttgcaatgttataaattagttttcttactgtatgccttcttcgccttttgcaaaatggtcatcatgctcttattatcagatgctacagaattggacgggcattatgaacatacagattgcaatgaagaaacagctgaaccattggacgttaacgatgaaactgcaccattaatgagacaagcaactcacccagaagaaagatccaacaaactatctaaggagaccgtttcggttttgatgaaattgttagtaatcttcatggtcgactctctcgggtccgggtttatgacaagtggctggatggtttactactatagtaagcaatttttgatgggatctctggcgttgggtactttatttttcatcacgcaactggttatggcatcttccaccatcccatcatcaataattgccagatgttttggcccagtaagagccacactattggtccaaattccatcagggatattttctattctcatccctatggccaagaattacttgcccttatctattttgtttttgaatctgcattttgcaacaactgccatggacgttacaccaaggcaaattctattaacaaatatcatcaaaccaagagatttaaccaaagttatgggggtggtcaacattggaaagacatttgctcggtgtgttggtccaatattcacgggtatacttgctaacaataattatttatggctatgttacatcattagtgggtccttggtgataacggcggatctaatactggcatgcatgtttttaggagtggacgctaaaattaaaaagcaaatgaaccgccattaa

SEQ ID NO: 110 - protein, 448 aa, Saccharomyces cerevisiae
MAPEIFVKFKCASRDIKLLWASVFLRLLSYGLTNQVLTLFLNAINMTEDKIGLFMSLTLAGDVICSYILTWYADSWGRRRVLVYGCAMMLLSGLVFSFSENFTLLLVFAIFGVISPSSDEVGPFKSIEEAMIAHLSPHNARPEIYAIHALVGTIGSALGAIICGIFVDLLKRTGLAATDLQCYKLVFLLYAFFAFCKMVIMLLLSDATELDGHYEHTDCNEETAEPLDVNDETAPLMRQATHPEERSNKLSKETVSVLMKLLVIFMVDSLGSGFMTSGWMVYYYSKQFLMGSLALGTLFFITQLVMASSTIPSSIIARCFGPVRATLLVQIPSGIFSILIPMAKNYLPLSILFLNLHFATTAMDVTPRQILLTNIIKPRDLTKVMGVVNIGKTFARCVGPIFTGILANNNYLWLCYIISGSLVITADLILACMFLGVDAKIKKQMNRH

SEQ ID NO: 111 - DNA, 933 bp, Saccharomyces cerevisiae
atgacatctatagataatagacctttgccgttcatataccagttcacagccggtgccattgccggcgtctcggagctattggtgatgtatccattggacgtggtgaagacaagaatgcaattacaagtgacaaccaaaggtcatcccgctgttgttgcagcgaaagcagcagtagatcactacacgggcgtgatggattgtcttacaaaaattgtgaagaaggaaggattttcgcatctttacaagggtatcacatcgcctatattaatggaggctccgaaaagagcaattaagttctccggaaacgatacattccaaacgttttataaaaagattttccccacgcccaatggggagatgactcaaaaaatcgccatatacagtggtgcgtccgctggcgccgtggaagcctttgtcgtcgcgccttttgaactagtgaagattagattacaggatgtgaattcacagttcaagacacccattgaagttgtaaagaatagtgttgtgaaaggtggtgttttgtcacttttcaatgggttggaagccactatctggagacacgttctttggaatgccggttatttcggtataatattccaaattcggaagcttttgccggcggctaaaacaagcacggaaaagaccagaaatgatttgatcgcaggtgctattggtggcactgtcgggtgcttgttgaatacaccatttgacgtggtaaaatctaggatccaaagaagttccgggccgctgaggaagtacaactggtccctgccttcagtgctgttagtttaccgtgaggaagggtttaaagcattgtataagggatttgcgccaaaggtcatgagacttgcccccggtggtgggttattgttggtagttttcacgaacgtcatggattttttcagagaagtcaagtatggtaaaaaacaatga

SEQ ID NO: 112 - protein, 310 aa, Saccharomyces cerevisiae
MTSIDNRPLPFIYQFTAGAIAGVSELLVMYPLDVVKTRMQLQVTTKGHPAVVAAKAAVDHYTGVMDCLTKIVKKEGFSHLYKGITSPILMEAPKRAIKFSGNDTFQTFYKKIFPTPNGEMTQKIAIYSGASAGAVEAFVVAPFELVKIRLQDVNSQFKTPIEVVKNSVVKGGVLSLFNGLEATIWRHVLWNAGYFGIIFQIRKLLPAAKTSTEKTRNDLIAGAIGGTVGCLLNTPFDVVKSRIQRSSGPLRKYNWSLPSVLLVYREEGFKALYKGFAPKVMRLAPGGGLLLVVFTNVMDFFREVKYGKKQ

SEQ ID NO: 113 - DNA, 918 bp, Saccharomyces cerevisiae
atgtcttcgaacgattcgaacgataccgacaagcaacatacacgtctggatcctaccggtgtggacgacgcctacatccctccggagcagccggaaacaaagcaccatcgctttaaaatctctagggacaccctgagagaccactttatcgctgcggtcggtgagttctgcggcacattcatgtttttatggtgcgcttacgttatctgcaatgtcgctaaccatgatgtcgcactcgttgcagcgcctgacggttcccatccgggtcaattgattatgattgccatcggtttcggattttccgtcatgttttctatctggtgttttgccggtgtctctggtggggctttgaatcctgctatgtcgctttcgctgtgcttggcgagagccgtctctcctacaagatgtgtcgttatgtgggtttcgcagattgttgctggaatggccgctggaggcgctgcaagcgccatgacacctggtgaagtcctctttgccaattctttgggcctgggctgctctaggacgaggggtctgttcctggagatgttcggcaccgctatcctatgtttaacagtcttaatgacggctgtggagaagcgtgaaaccaactttatggctgcgctgcccatcggcatctccctgtttatcgcacacgtcgctttgactgcatacacaggcacaggtgtcaaccctgcgaggtccttgggtgctgctgtcgcagccagatacttccctcattaccactggatttattggattggcacgctgttaggatccattttagcatggtctgtatggcaattattgcaaatcttagactacacaacctacgttaccgctgaaaaggctgccagcaccaaggaaaaagctcaaaaaaaaggtgaaaccagcagttcctctgctgtggctgaagtctaa

SEQ ID NO: 114 - protein, 305 aa, Saccharomyces cerevisiae
MSSNDSNDTDKQHTRLDPTGVDDAYIPPEQPETKHHRFKISRDTLRDHFIAAVGEFCGTFMFLWCAYVICNVANHDVALVAAPDGSHPGQLIMIAIGFGFSVMFSIWCFAGVSGGALNPAMSLSLCLARAVSPTRCVVMWVSQIVAGMAAGGAASAMTPGEVLFANSLGLGCSRTRGLFLEMFGTAILCLTVLMTAVEKRETNFMAALPIGISLFIAHVALTAYTGTGVNPARSLGAAVAARYFPHYHWIYWIGTLLGSILAWSVWQLLQILDYTTYVTAEKAASTKEKAQKKGETSSSSAVAEV

SEQ ID NO: 115 - DNA, 2634 bp, Saccharomyces cerevisiae
atgagtgaaacagtcaaagataaagttataattgatgagaaggtatccacaaaaggtactgttgattacgccgagggtgctgagtattctgagaggctttcaaatcattcatcagacttttctcagtggtatacggatgaacagatactgcactttatgaagaagctgggttatgaaaatcgcactctttatgatattccggaagacgttgcgtatatcctcaaaaaaatgcctgaattgacacttgaggattccttcaaaatactaaaagactctatcatctatttcaaggatgatgagaacattccacacgatcaatatgaggagtggaagagattggttgacttggaggacttggattcaaaagaggggatagatgaatatgatagctttgacattagagcatttgcttctgctattaaatttcattcgccttaccaagaggttagagctgttgttgatccagaagatgatcccaccattccagtggagacattccgagcatattttctggcaataatttggtctgtcatcggttcaggatttaatgagtttttttcacacagggtggtttcaatttcactgaatactccaattatccaaatgtttttatatatctgtggtaaggcttgggctaaaactatcccctgttggactataaccatcaggggcagaaagtatggtatcaatatcgataaaccatggacccaaaaagagcaaatgttttcaaccttgttatatgcaatttgtcaaggcgcgttctatactcattacaatattctaacgcaaaaactcttttaccattctgctttctcgtttggctaccaatttttactttcgttatccgtacaatttattggatttggatttgctggcatccttagaaaattcgttgtttatccagcccgtgcactatggccaacagtcatgccaactattgctatcaacaaggcactattgggtaaagaaaagcatgaatctggaatgagcaggtataaattctttttcttgactttttttatcatgttcatctataactggtttcccacttacattattaatattctaaacactttcaattggatgacctggatcaagccaagtaacattaatctcgcaaacatcacgggaggagtcactggtcttgggattaatcctatctcatcttttgactggaatgttatttcgtttaattctcctttagtttacccattttggtcatacttaacacaatatcttggttgcatattagcagctttaattgttattgcagtatactatagtaattatatgagttgccaatacctgccaatattcacaaattctttgtatactaatactggccattcctttaaagttactgaggtattagacagtgacaataagctagatgtgaaaaaatatcaaagctactcgccaccatactatagtgctggaaatttggtatcatatggtgctttcatttgcgcatatcctctgatgattacatggtcgtttattgtacactcaaagttattgttcaatgctttcaaagattgggctttgaatttgtgggccatgagaaaacttaaatcttgggtcacaatgttcaaaagcgattacagggcgctcgacgattatgatgacccacattctaatgccatgaaaaactataaagaagttccagattggtggtattttgccatattgataggttcacttgttgttggaatagctgttgtagagcactacccaacaaatacaccagtttggggtctttttgtttgtttaggatttaattttgttttcttgattccaactactatccttcaagcaaccactggttattcgtttggtttgaatctactaattgaaatggtgatggggtacgctttaccaggtaatccaatcgccataatgattttgaaggcttttggttataacatcgacggccaagcagataattacgtttctaacttaaaaatagcgcattattgtaagattccgccaatggcgctattcaggggacaatgtgttatagttttcattcagatatttgtcaatctaggtgttctgaattggcaaatctccaatatcaaagacttttgcacacctcatcaaaacgcaaaattcacctgtcctgatgctgtgacctactataatgcttccgttgtctggggtgcaattgggccaaaaagaattttcaattacatttatccaatatttaaatggtgttggttgataggcgcatgcattggcatattttttggtgtttggaagcgctggggtaagttttatcccagatattttgacccaatgttatttgtaggtggaatgcttaatatgagccctccatataacctgatgtattacacttctggtatgattgttagttacatttcccagtactacatgaaaagacaccatttaaatctgtgggagaaatataattatgttttatcggcaggcttttcaacgggcttggttttatcagctattatcattttctttgctgtccaatataaagacacagcttttaattggtggggcaatacagttccgtatgctggtgccgatggcgttggctatcctctaaagaacataactgatacagcaaatggctatttcggctatgctccaggacactatccatga

SEQ ID NO: 116 - protein, 877 aa, Saccharomyces cerevisiae
MSETVKDKVIIDEKVSTKGTVDYAEGAEYSERLSNHSSDFSQWYTDEQILHFMKKLGYENRTLYDIPEDVAYILKKMPELTLEDSFKILKDSIIYFKDDENIPHDQYEEWKRLVDLEDLDSKEGIDEYDSFDIRAFASAIKFHSPYQEVRAVVDPEDDPTIPVETFRAYFLAIIWSVIGSGFNEFFSHRVVSISLNTPIIQMFLYICGKAWAKTIPCWTITIRGRKYGINIDKPWTQKEQMFSTLLYAICQGAFYTHYNILTQKLFYHSAFSFGYQFLLSLSVQFIGFGFAGILRKFVVYPARALWPTVMPTIAINKALLGKEKHESGMSRYKFFFLTFFIMFIYNWFPTYIINILNTFNWMTWIKPSNINLANITGGVTGLGINPISSFDWNVISFNSPLVYPFWSYLTQYLGCILAALIVIAVYYSNYMSCQYLPIFTNSLYTNTGHSFKVTEVLDSDNKLDVKKYQSYSPPYYSAGNLVSYGAFICAYPLMITWSFIVHSKLLFNAFKDWALNLWAMRKLKSWVTMFKSDYRALDDYDDPHSNAMKNYKEVPDWWYFAILIGSLVVGIAVVEHYPTNTPVWGLFVCLGFNFVFLIPTTILQATTGYSFGLNLLIEMVMGYALPGNPIAIMILKAFGYNIDGQADNYVSNLKIAHYCKIPPMALFRGQCVIVFIQIFVNLGVLNWQISNIKDFCTPHQNAKFTCPDAVTYYNASVVWGAIGPKRIFNYIYPIFKWCWLIGACIGIFFGVWKRWGKFYPRYFDPMLFVGGMLNMSPPYNLMYYTSGMIVSYISQYYMKRHHLNLWEKYNYVLSAGFSTGLVLSAIIIFFAVQYKDTAFNWWGNTVPYAGADGVGYPLKNITDTANGYFGYAPGHYP

SEQ ID NO: 117 - DNA, 1632 bp, Saccharomyces cerevisiae
atgaagagtactttgagtttaactttatgtgttatatcgcttctattaaccctttttctggcggccttggatattgttatagtggttactttatatgatacaattggcattaagttccatgacttcggcaatattggttggttagttactggatatgctctttctaatgctgttttcatgttattatggggtcgcttggccgaaatacttggtacaaaggagtgcttaatgatttctgttattgtatttgaaatagggtctttgatttctgctctttcgaattcaatggcgactctgattagcggaagagtcgttgctgggtttggaggaagtggaattgaatcacttgcttttgtagttggaacatccattgtccgagaaaaccatagaggaattatgataacggcactcgctatatcgtatgtcattgcagagggagtcgggccttttattggtggtgcatttaatgaacatttgtcttggagatggtgcttttatataaatcttccaatcggtgcgtttgcgttcataatattggcattttgtaacacatctggagaaccacatcaaaaaatgtggctaccatcaaaaatcaaaaaaattatgaactatgactatggcgaattattgaaagcaagtttttggaagaatacatttgaagtacttgtatttaaactagacatggttgggattattttatcttcagcaggctttacactactgatgttaggtctttcatttggtggaaacaacttcccatggaattcgggtatcattatttgcttttttaccgtgggccctatcttattgttactattttgtgcttacgactttcattttctgtcattatcggggcttcactatgacaacaagcggatcaaaccgttactgacatggaatattgcctcaaattgtggcatatttacaagctccataacaggattcctttcttgctttgcttatgaattacagtctgcttatttagtccagctttatcaactagtatttaaaaaaaagcctacattagcgagtatacatctttgggaactatcaattccagctatgattgcaactatggccatagcatatctaaattcaaaatatggcatcatcaaaccggcaattgtttttggtgtgctttgtgggattgttggatctggtttatttacgctaatcaatggcgaactctctcagtcaataggttattcaattctcccaggaatagcttttggtagtattttccaagcaacgttattaagctcccaggtgcagataacatcagacgatccagactttcaaaacaagtttattgaagtcacagctttcaactcgttcgccaaatccttgggctttgcgtttggagggaatatgggggcaatgatattcactgcatcactcaaaaaccagatgcgctcttcccaattaaacataccacaatttacgtctgtagaaacacttttagcgtatagcacagaacattatgatggcccccaatcttcactatcaaagttcataaacacagctatccatgacgttttttactgcgccttaggatgctatgctctttcattcttctttggaatattcacttcgagtaagaaaacaacaatatcagccaaaaagcaacaatga

SEQ ID NO: 118 - protein, 543 aa, Saccharomyces cerevisiae
MKSTLSLTLCVISLLLTLFLAALDIVIVVTLYDTIGIKFHDFGNIGWLVTGYALSNAVFMLLWGRLAEILGTKECLMISVIVFEIGSLISALSNSMATLISGRVVAGFGGSGIESLAFVVGTSIVRENHRGIMITALAISYVIAEGVGPFIGGAFNEHLSWRWCFYINLPIGAFAFIILAFCNTSGEPHQKMWLPSKIKKIMNYDYGELLKASFWKNTFEVLVFKLDMVGIILSSAGFTLLMLGLSFGGNNFPWNSGIIICFFTVGPILLLLFCAYDFHFLSLSGLHYDNKRIKPLLTWNIASNCGIFTSSITGFLSCFAYELQSAYLVQLYQLVFKKKPTLASIHLWELSIPAMIATMAIAYLNSKYGIIKPAIVFGVLCGIVGSGLFTLINGELSQSIGYSILPGIAFGSIFQATLLSSQVQITSDDPDFQNKFIEVTAFNSFAKSLGFAFGGNMGAMIFTASLKNQMRSSQLNIPQFTSVETLLAYSTEHYDGPQSSLSKFINTAIHDVFYCALGCYALSFFFGIFTSSKKTTISAKKQQ

SEQ ID NO: 119 - DNA, 1215 bp, Saccharomyces cerevisiae
atgtcagaagatcaaaaaagtgaaaattcggtaccttctaaggttaatatggtgaatcgcaccgatatactgactacgatcaagtcattgtcatggcttgacttgatgttgccatttactataattctctccataatcattgcagtaataatttctgtctatgtgccttcttcccgtcacacttttgacgctgaaggtcatcccaatctaatgggagtgtccattcctttgactgttggtatgattgtaatgatgattcccccgatctgcaaagtttcctgggagtctattcacaagtacttctacaggagctatataaggaagcaactagccctctcgttatttttgaattgggtcatcggtcctttgttgatgacagcattggcgtggatggcgctattcgattataaggaataccgtcaaggcattattatgatcggagtagctagatgcattgccatggtgctaatttggaatcagattgctggaggagacaatgatctctgcgtcgtgcttgttattacaaactcgcttttacagatggtattatatgcaccattgcagatattttactgttatgttatttctcatgaccacctgaatacttcaaatagggtattattcgaagaggttgcaaagtctgtcggagtttttctcggcataccactgggaattggcattatcatacgtttgggaagtcttaccatagctggtaaaagtaattatgaaaaatacattttgagatttatttctccatgggcaatgatcggatttcattacactttatttgttatttttattagtagaggttatcaatttatccacgaaattggttctgcaatattgtgctttgtcccattggtgctttacttctttattgcatggtttttgaccttcgcattaatgaggtacttatcaatatctaggagtgatacacaaagagaatgtagctgtgaccaagaactacttttaaagagggtctggggaagaaagtcttgtgaagctagcttttctattacgatgacgcaatgtttcactatggcttcaaataattttgaactatccctggcaattgctatttccttatatggtaacaatagcaagcaagcaatagctgcaacatttgggccgttgctagaagttccaattttattgattttggcaatagtcgcgaggatccttaaaccatattatatatggaacaatagaaattaa

SEQ ID NO: 120 - protein, 404 aa, Saccharomyces cerevisiae
MSEDQKSENSVPSKVNMVNRTDILTTIKSLSWLDLMLPFTIILSIIIAVIISVYVPSSRHTFDAEGHPNLMGVSIPLTVGMIVMMIPPICKVSWESIHKYFYRSYIRKQLALSLFLNWVIGPLLMTALAWMALFDYKEYRQGIIMIGVARCIAMVLIWNQIAGGDNDLCVVLVITNSLLQMVLYAPLQIFYCYVISHDHLNTSNRVLFEEVAKSVGVFLGIPLGIGIIIRLGSLTIAGKSNYEKYILRFISPWAMIGFHYTLFVIFISRGYQFIHEIGSAILCFVPLVLYFFIAWFLTFALMRYLSISRSDTQRECSCDQELLLKRVWGRKSCEASFSITMTQCFTMASNNFELSLAIAISLYGNNSKQAIAATFGPLLEVPILLILAIVARILKPYYIWNNRN

SEQ ID NO: 121 - DNA, 1782 bp, Saccharomyces cerevisiae
atgtattcaattgttaaagagattattgtagatccttacaaaagactaaaatggggttttattccagtaaagcggcaggtggaagacctgccagatgacttaaattcaacagaaattgtcactatctccaacagtatccagagtcatgaaacagctgaaaatttcatcacgactacaagtgaaaaagatcaactacattttgagactagtagctatagtgaacataaagacaatgtgaacgttactagaagttatgaatatagagatgaagccgataggccatggtggagatttttcgatgaacaagagtatcggatcaatgaaaaggaaagatctcacaataaatggtatagttggttcaaacagggtacctctttcaaagaaaaaaaattattaattaaattggatgtccttttagccttttattcttgtattgcttattgggtgaaatatctggatacggttaatataaacaacgcttacgtttcgggaatgaaggaagatttaggctttcaaggtaatgatttggtgcatactcaagtaatgtacacagttggtaatattatatttcaattgccatttttgatttacctgaacaagctcccattaaactatgttttaccaagcctcgacttatgttggtcgcttttaaccgttggtgctgcatatgtcaattctgtaccacacttgaaagcaattaggtttttcattggggcttttgaagcgccaagttatttggcataccaatatttgtttggttccttttacaaacatgatgaaatggtgcgtcgttctgctttttactatttgggccagtatatcggtattctatccgctggtgggatccagtcagccgtatattcatcgttaaatggtgtaaatggtttagagggatggagatggaactttattattgacgctattgtgtctgtcgtagtgggccttattggattttactccctgccaggtgacccatacaactgttattctattttcttaactgatgatgaaattaggttggcgaggaaaagattaaaagaaaaccaaacaggtaaaagtgattttgaaacaaaagtattcgatattaaactgtggaaaacaattttcagtgattggaaaatatacattttaactttatggaatattttctgttggaatgacagtaatgtttcatctggggcatacctactatggttgaaatctttgaaaagatactctattcctaagctcaatcagttatccatgattactccgggtttaggtatggtttatttgatgcttactggtattattgcagataaattacactctcgttggtttgcgattatttttactcaggttttcaatatcattggtaactccatattagccgcttgggacgtcgcagaaggagccaaatggtttgcatttatgctgcaatgttttggttgggctatggctcctgttttatactcttggcaaaacgatatttgtcgccgagatgctcaaactagagctattactttagttacaatgaatattatggctcaatcatctaccgcatggataagtgttttggtttggaaaacagaagaagctcccaggtatttaaaggggtttactttcactgcatgttctgctttttgtctctccatttggacttttgttgtactctacttctataaacgtgatgaaaggaacaatgccaagaagaacggtattgtgctttataactctaaacatggtgtggaaaagccaacgtcaaaagacgttgaaaccttatcagtatctgatgaaaaataa

SEQ ID NO: 122 - protein, 593 aa, Saccharomyces cerevisiae
MYSIVKEIIVDPYKRLKWGFIPVKRQVEDLPDDLNSTEIVTISNSIQSHETAENFITTTSEKDQLHFETSSYSEHKDNVNVTRSYEYRDEADRPWWRFFDEQEYRINEKERSHNKWYSWFKQGTSFKEKKLLIKLDVLLAFYSCIAYWVKYLDTVNINNAYVSGMKEDLGFQGNDLVHTQVMYTVGNIIFQLPFLIYLNKLPLNYVLPSLDLCWSLLTVGAAYVNSVPHLKAIRFFIGAFEAPSYLAYQYLFGSFYKHDEMVRRSAFYYLGQYIGILSAGGIQSAVYSSLNGVNGLEGWRWNFIIDAIVSVVVGLIGFYSLPGDPYNCYSIFLTDDEIRLARKRLKENQTGKSDFETKVFDIKLWKTIFSDWKIYILTLWNIFCWNDSNVSSGAYLLWLKSLKRYSIPKLNQLSMITPGLGMVYLMLTGIIADKLHSRWFAIIFTQVFNIIGNSILAAWDVAEGAKWFAFMLQCFGWAMAPVLYSWQNDICRRDAQTRAITLVTMNIMAQSSTAWISVLVWKTEEAPRYLKGFTFTACSAFCLSIWTFVVLYFYKRDERNNAKKNGIVLYNSKHGVEKPTSKDVETLSVSDEK

SEQ ID NO: 123 - DNA, 1380 bp, Saccharomyces cerevisiae
atgccgtcaaacgtacgttcgggagtcttaactttgctccatacagcatgtggagcaggcgtacttgcaatgccgtttgcattcaagccatttgggttaatgcctggtctgataacgctaacattttgcggaatatgttccttatgtgggctgctattacagactcgaatagcgaagtacgtacctaaatctgagaacgcctcgtttgctaaactcacccaactaatcaatccgtcaataagtgtagtgttcgattttgccattgctgttaaatgttttggcgttggtgtatcttacttaattattgttggtgacttagtgccacagatagtgcagtcaattttttatcgtaacgatgataacatgagtggttcgcaagagcatcacatgttcttagacaggcgtttgtatataactctgatcatagtgtttgttatctcccctttatgctttaaaagaagtttgaattctctacgatatgcttctatgattgccattgttagtgtcgcatatttatctggtttgattatttaccattttgtaaatcggcatcagctagagagagggcaagtatattttatggtacctcacggagattctcagtctcattctcccctgactacattgccaatttttgtgtttgcttacacttgtcaccacaatatgttcagtgtaattaatgagcaagtggataagagcttcaaggtaatcaggaggattccgatttttgccatcgtgttggcctattttttatacatcataattggtggtacaggttatatgacatttggtgagaatattgtaggaaatatcctcactttatacccgaattccatctccaccaccatcgggaggttagcaatgctgctattagttatgttagcatttccattgcaatgccatccttgcagatcatcggtaaaaaacataattatattcattgaaaatttcagaaaaggtaagttatacgataacagagctagctttattccattagacaactttaatagtgaagatccgcaggaggcgccaacccaacaaaacaacgaagagccaaatctgcgtagtgagtctttacggcatatcaatattatcaccctttgtatcttactgttctcatatctactggctatttcaattacgtctctagcaaaagtcctagcaatagttggtgccacgggatctacgtcgatttctttcattttgccaggcctttttggttataaattaattggctcagaatttacgggcacgaatgaaagagtaccgacaagcataaaaatattcaaatacttaagtttatctctattcatctgggggatagcagtaatggtagcttcactatcagcgattgtatttttgggcacatcatcacattga

SEQ ID NO: 124 - protein, 459 aa, Saccharomyces cerevisiae
MPSNVRSGVLTLLHTACGAGVLAMPFAFKPFGLMPGLITLTFCGICSLCGLLLQTRIAKYVPKSENASFAKLTQLINPSISVVFDFAIAVKCFGVGVSYLIIVGDLVPQIVQSIFYRNDDNMSGSQEHHMFLDRRLYITLIIVFVISPLCFKRSLNSLRYASMIAIVSVAYLSGLIIYHFVNRHQLERGQVYFMVPHGDSQSHSPLTTLPIFVFAYTCHHNMFSVINEQVDKSFKVIRRIPIFAIVLAYFLYIIIGGTGYMTFGENIVGNILTLYPNSISTTIGRLAMLLLVMLAFPLQCHPCRSSVKNIIIFIENFRKGKLYDNRASFIPLDNFNSEDPQEAPTQQNNEEPNLRSESLRHINIITLCILLFSYLLAISITSLAKVLAIVGATGSTSISFILPGLFGYKLIGSEFTGTNERVPTSIKIFKYLSLSLFIWGIAVMVASLSAIVFLGTSSH

SEQ ID NO: 125 - DNA, 1539 bp, Saccharomyces cerevisiae
atgatgaaggaatcgaaatctatcactcaacatgaggttgagagagaatctgtttcttccaagcgtgccattaaaaagagattacttctgtttaaaatagacttgtttgtgctatcatttgtttgcttgcaatactggattaattatgtcgaccgtgtcggtttcaccaatgcatatatatccggtatgaaggaagatcttaagatggtcggaaacgatttgaccgtgtctaacacagttttcatgattggttacattgtaggtatggtccccaataatttaatgttattgtgtgttccgcccaggatatggctaagtttttgtacgtttgcttggggtttattgaccttgggaatgtacaaagttacatcgttcaaacatatttgcgcaattagattctttcaagccttatttgagagttgcacattttcaggaacacattttgttttgggttcgtggtataaagaagacgaattgcccattagaagtgctatttttacaggtagcggtttggtgggatctatgttcagtggatttatgcaaacaagtatctttactcatttgaatgggcggaatggcttggcgggttggagatggttattcattattgatttttgtatcacattacccattgcaatttatgggtttattttcttccccggccttcctgatcaaacaagtgctgttagcaaattttctatgacgagatacatttttaatgaacaagagctacattatgctaggagaaggctccccgctagggacgaaagcacccggttagactggtcgactattcctagagtcttaaaaaggtggcactggtggatgttctctcttgtttgggttctgggaggtgagaacttgggtttcgcatctaattctacatttgcattatggttacaaaaccaaaaatatacgttggcgcaaagaaataattatccttcggggatatttgccgtaggtatagtttctacgctttgttctgctgtatatatgagtaagatcccaagagctaggcattggcatgtttctgttttcatatcattggtaatggttattgttgcggtactaatacgtgcagacccactaaatccaaaagtcgtcttttctgcacagtatcttggaggcgtagcatacgctggacaagcggtttttttttcgtgggcaaacattatttgtcatgcagatcttcaagaacgtgctatcgttcttgcttccatgaatatgttttcaggggccgttaacgcatggtggtctatattattctttgcttcagatatggtgcccaagtttgagagaggttgctacgccctcttggctacggcaatatcaagcggaattgtctcggtcgtcatacgctcactacagataaaagagaatttgtctaagaaacaggttccttatatagatgctaatgacatgcccggagaagatgacgatgacgacaaccaggataatgaaaatgatggcgacgacgagagtatggaagttgaacttcataatgaggaaatggccgaaatttcaaatcctttccgatag

SEQ ID NO: 126 - protein, 512 aa, Saccharomyces cerevisiae
MMKESKSITQHEVERESVSSKRAIKKRLLLFKIDLFVLSFVCLQYWINYVDRVGFTNAYISGMKEDLKMVGNDLTVSNTVFMIGYIVGMVPNNLMLLCVPPRIWLSFCTFAWGLLTLGMYKVTSFKHICAIRFFQALFESCTFSGTHFVLGSWYKEDELPIRSAIFTGSGLVGSMFSGFMQTSIFTHLNGRNGLAGWRWLFIIDFCITLPIAIYGFIFFPGLPDQTSAVSKFSMTRYIFNEQELHYARRRLPARDESTRLDWSTIPRVLKRWHWWMFSLVWVLGGENLGFASNSTFALWLQNQKYTLAQRNNYPSGIFAVGIVSTLCSAVYMSKIPRARHWHVSVFISLVMVIVAVLIRADPLNPKVVFSAQYLGGVAYAGQAVFFSWANIICHADLQERAIVLASMNMFSGAVNAWWSILFFASDMVPKFERGCYALLATAISSGIVSVVIRSLQIKENLSKKQVPYIDANDMPGEDDDDDNQDNENDGDDESMEVELHNEEMAEISNPFR

SEQ ID NO: 127 - DNA, 1113 bp, Saccharomyces cerevisiae
atgaatcgtgttggtatagacgtagatcatatgataggggtcctgcttctggccgtagtggtggtgttttgggttggcgcttcgtgtttgactaatgaattgctcgagacaaacgcgtacaataaacctttcttccttacttatctaaacatatcatcgtttgctctttatttgacgccagatctatggaggataatccaatcaagaaggaagagcttgcaggaacggacagaacgaacattacctattcacacacaagaatctttttcagagttcctacctttactatcttcaactccttctacttcttcaaatttgtcttcgatagcggacacgaaagtgaaggatacaatgaggttgagtctgctattttgcgtcttgtggttcgtggcaaatttggcggctaacgctgctttgtcgtataccacagtggcttcgtcaacaattctttcatcgacatcctcattttttaccttatttcttgccactagtctaggaatagaaactttttcgacaaaaaaactgctggggttatttgtgtctttgtttggaattatcttaattgtgatgcaatcctcgaagcaacaggattctgtgagtgcttcctcctttttggtaggtaacactttagcactgctggggtcattgggttacagtgtctatacaacccttttgaaatacgaaatatcatccaaaggtctcagactagacattcagatgtttcttggttatgttggtatcttcacgtttctgttgttttggccaattttaataatcctggatataacacatatggaaacttttgaactaccaagtaacttccacatttcttttcttgtcatgttaaattgtatcattatctttgttagtgactatttttggtgtaaagccctcattttgacatcacccttggtggttaccgttgccttaacttttactatcccgttagccatgttcgctgattttgtatggcgagaggcattttttacgccttggtatatcattggtgttattttcatttttgtttcattctttctagttaaccatcggggagaatctgctgttgaaaaggactgtgctgcggttgaaaaaggacctatcttggatgcctaa

SEQ ID NO: 128 - protein, 370 aa, Saccharomyces cerevisiae
MNRVGIDVDHMIGVLLLAVVVVFWVGASCLTNELLETNAYNKPFFLTYLNISSFALYLTPDLWRIIQSRRKSLQERTERTLPIHTQESFSEFLPLLSSTPSTSSNLSSIADTKVKDTMRLSLLFCVLWFVANLAANAALSYTTVASSTILSSTSSFFTLFLATSLGIETFSTKKLLGLFVSLFGIILIVMQSSKQQDSVSASSFLVGNTLALLGSLGYSVYTTLLKYEISSKGLRLDIQMFLGYVGIFTFLLFWPILIILDITHMETFELPSNFHISFLVMLNCIIIFVSDYFWCKALILTSPLVVTVALTFTIPLAMFADFVWREAFFTPWYIIGVIFIFVSFFLVNHRGESAVEKDCAAVEKGPILDA

SEQ ID NO: 129 - DNA, 1641 bp, Saccharomyces cerevisiae
atggttagttcaagtgtttccattttggggactagcgccaaggcatccacttctctaagtagaaaggatgaaattaaactaacccctgaaacaagggaagctagcttggacattccatacaaacccattattgcatactggacggtgatgggtctctgtctgatgattgcctttggtggattcatttttggttgggatacaggaaccatttcagggtttattaaccaaacagatttcaagagaaggtttggtgagttacaaagggacggcagttttcaactatcagatgtcaggacagggctaattgtcggtatcttcaacataggttgtgctttaggtggcctaacgctgggacgcctgggcgatatttatgggcgtaaaatcggcttaatgtgtgttatactggtgtatgttgttggtatcgtgatccagattgcttcctctgacaaatggtatcaatattttattggtagaattgtttctggaatgggtgttggaggtgttgctgtgctgtcgccaactttgatctcagaaatttccccaaagcacctaagaggcacttgtgtctctttttaccagctaatgattacccttggaattttcttgggctactgtaccaattatggtacaaagaaatattcaaattcaatacagtggcgggttcccttgggtttgtgttttgcgtgggcaatctttatggtgattggaatggttatggttccggaatcgcccagatatttagtagaaaaaggtaagtatgaagaagctagaaggtctttggccaaatcaaacaaggtcacagttactgatccaggcgttgtttttgagtttgatactatagttgcaaatatggaattagaaagggctgttggaaatgccagttggcacgaactcttctcaaataaaggagcaattctaccaagggtaataatgggaatcgttatccagtcactgcaacagcttactggctgtaattattttttctactacggcacgaccattttcaatgctgttggaatgcaagactctttcgagacttccattgtccttggggctgttaattttgcttctacatttgttgcactatacattgtggataaatttgggcgtcgaaaatgtttattgtgggggtctgcctcgatggcaatttgtttcgtcatattcgccaccgttggcgtcactagattatggccacaagggaaagaccaaccttcttcgcaaagtgctggtaatgttatgatcgtttttacttgtttcttcattttctcttttgccattacttgggctcctatcgcctatgtcattgtggcagaaacttatccattaagagttaaaaatcgtgccatggccattgcggttggtgcgaactggatgtggggtttcttgattggatttttcacaccctttatcactagatccataggattttcttatggctatgttttcatgggttgcttaatcttttcgtacttctacgttttcttctttgtttgcgaaacaaagggattaactctggaggaagttaatgaaatgtacgaagaaagaataaagccatggaagtccggaggttggattcccagttctagaagaacaccacaaccaacaagcagtacaccattagttattgttgatagtaaataa

SEQ ID NO: 130 - protein, 546 aa, Saccharomyces cerevisiae
MVSSSVSILGTSAKASTSLSRKDEIKLTPETREASLDIPYKPIIAYWTVMGLCLMIAFGGFIFGWDTGTISGFINQTDFKRRFGELQRDGSFQLSDVRTGLIVGIFNIGCALGGLTLGRLGDIYGRKIGLMCVILVYVVGIVIQIASSDKWYQYFIGRIVSGMGVGGVAVLSPTLISEISPKHLRGTCVSFYQLMITLGIFLGYCTNYGTKKYSNSIQWRVPLGLCFAWAIFMVIGMVMVPESPRYLVEKGKYEEARRSLAKSNKVTVTDPGVVFEFDTIVANMELERAVGNASWHELFSNKGAILPRVIMGIVIQSLQQLTGCNYFFYYGTTIFNAVGMQDSFETSIVLGAVNFASTFVALYIVDKFGRRKCLLWGSASMAICFVIFATVGVTRLWPQGKDQPSSQSAGNVMIVFTCFFIFSFAITWAPIAYVIVAETYPLRVKNRAMAIAVGANWMWGFLIGFFTPFITRSIGFSYGYVFMGCLIFSYFYVFFFVCETKGLTLEEVNEMYEERIKPWKSGGWIPSSRRTPQPTSSTPLVIVDSK

SEQ ID NO: 131 - DNA, 1683 bp, Saccharomyces cerevisiae
atgtcgctgatcagcatcctgtctcccctaattacttccgagggcttagattcaagaatcaaaccttcaccaaaaaaggatgcctctactaccactaagccatcactatggaaaactactgagttcaaattctactacattgcatttctggtcgtggttcccttgatgttctatgctgggttacaagctagttcgcccgaaaatccaaactatgcaagatacgaacgtctcctatctcaaggttggttatttggcagaaaagtagacaatagtgattctcaatataggtttttcagggacaattttgcgctattgtcagttttaatgctagtccacacttctataaaacgcattgtactttattcaacaaatatcactaaattgaggtttgatctgatatttggtttgatctttttagtggccgctcatggtgtcaattcgataagaattttagcccatatgctaattttatatgccatcgcccatgtactaaagaactttagaagaatagccaccatcagcatttggatttatggtatttctacgctttttattaacgacaacttcagagcatatccatttggtaatatttgctcttttttaagcccattggaccattggtatagaggtatcattccaagatgggatgtctttttcaattttactcttttgagagtcttaagttacaacttggacttcttagagaggtgggagaatttacaaaagaagaaaagtccatcctatgaatcaaaagaagctaaatcagccattttgctcaatgaacgtgctagattaactgctgcacaccccatacaggactacagcttaatgaattatattgcatatgttacttacacgccacttttcattgccggccccattataacattcaatgattatgtttaccaatcgaaacataccttgccatcaataaatttcaaattcattttttactatgcggtgagattcgttattgctctcttatctatggagttcattttacactttctccacgttgtggcaatctcaaaaaccaaagcgtgggaaaatgacacacctttccagatttccatgattggcttatttaatttgaatattatttggctaaaactactgattccgtggaggctgtttaggctgtgggctttgctagacggaatcgatacacctgaaaatatgatcaggtgtgttgataacaattacagttcactagcattctggagagcttggcatagaagctacaataagtgggttgtccgttacatatatattcctctaggtggttcaaaaaatagagttttgacatcactagcagtcttttccttcgtagctatatggcatgacatcgaactaaagttattattatggggttggctaatagttttgttcctcttaccagaaatttttgctacccaaattttctctcattataccgacgcagtctggtacagacacgtttgcgctgtcggtgctgttttcaacatatgggttatgatgatcgctaatctttttggattctgcttgggctctgacggtactaaaaaattactaagcgatatgttctgtaccgtatctggtttcaaatttgtaattttggcaagcgttagtttattcatcgcagtacaaataatgtttgaaatcagagaagaagaaaagaggcacggaatttacctaaaatgctga

SEQ ID NO: 132 - protein, 560 aa, Saccharomyces cerevisiae
MSLISILSPLITSEGLDSRIKPSPKKDASTTTKPSLWKTTEFKFYYIAFLVVVPLMFYAGLQASSPENPNYARYERLLSQGWLFGRKVDNSDSQYRFFRDNFALLSVLMLVHTSIKRIVLYSTNITKLRFDLIFGLIFLVAAHGVNSIRILAHMLILYAIAHVLKNFRRIATISIWIYGISTLFINDNFRAYPFGNICSFLSPLDHWYRGIIPRWDVFFNFTLLRVLSYNLDFLERWENLQKKKSPSYESKEAKSAILLNERARLTAAHPIQDYSLMNYIAYVTYTPLFIAGPIITFNDYVYQSKHTLPSINFKFIFYYAVRFVIALLSMEFILHFLHVVAISKTKAWENDTPFQISMIGLFNLNIIWLKLLIPWRLFRLWALLDGIDTPENMIRCVDNNYSSLAFWRAWHRSYNKWVVRYIYIPLGGSKNRVLTSLAVFSFVAIWHDIELKLLLWGWLIVLFLLPEIFATQIFSHYTDAVWYRHVCAVGAVFNIWVMMIANLFGFCLGSDGTKKLLSDMFCTVSGFKFVILASVSLFIAVQIMFEIREEEKRHGIYLKC

SEQ ID NO: 133 - DNA, 1461 bp, Saccharomyces cerevisiae
atgaataggattctatctagtgcatcgttgctatccaatgttagcatgccaaggcaaaacaagcataaaattacaaaggcgttatgttatgcaattatagtagcctcaatcggttcaatacaatttggttaccacttgtcggaattaaatgcacctcagcaggtgctttcgtgctcagaatttgacattcccatggagggctatccctatgacagaacatggctgggaaaaagaggatataagcaatgtataccattgaatgatgaacagattggaatcgtgacctccgttttttgcattggaggcattttgggctcttattttgccaccagtctggccaatatttatggaaggaagttctcaagtttaattaactgcacattgaatatcgtcggttcgctgataatcttcaattcgaatagttataggggcttaatcattggtagaattctagtgggtatttcgtgtggctctttgatcgtgattataccccttttcattaaggaagttgctccaagcggttgggaaggtttactgggttcgatgacacaaatctgtatcaggttaggggtcttgttgacacaaggaatagccctcccactgactgattcataccgttggaggtggattttgtttggtagcttccttatcgcggtattgaattttttcatgtggtttatagtcgatgaatctccaaaatggttgttagcacatggaagagtcaccgatgctaagttatctctatgtaagctacgtggcgtgacttttgatgaagccgcacaagagatacaggattggcaactgcaaatagaatctggggatccgttgattgaaccaaccaccacgaactctattagcggttctaattcattatggaaatacttgagggacagaacaaatgtcaagtctcgccatgttatcactgtattgttatttggccaacaattctgcggtataaactccattgtactatatggtaccaagataattagtcaactgtatcctcagcacgcaattaggataaactttttcattagtatggtgaatgtattagtcaccatactagtttctctgctaattcatagtttgccacgtaaaccgcttctgatgacgtccaccgtcttagtttctgttaccgccttcattatgggaatagcaatgaaccataataaaatgaaccttttgattgtgttttcatttatatatatgggcgttttcacgatggggttaaatccgttgccatttataataatgagagaagtatcaaaaccacaggatatggtccttgcgcaaagatatggtaccatttgcaattgggtaggaacttttatcattgcatatactttccctattattcatgatgttttgtcaggttatgttttcatcatttttgctatcatagcatgctcaataagcgcctttatctggaagaaggttccggagaccaagaggagcggctaa

SEQ ID NO: 134 - protein, 486 aa, Saccharomyces cerevisiae
MNRILSSASLLSNVSMPRQNKHKITKALCYAIIVASIGSIQFGYHLSELNAPQQVLSCSEFDIPMEGYPYDRTWLGKRGYKQCIPLNDEQIGIVTSVFCIGGILGSYFATSLANIYGRKFSSLINCTLNIVGSLIIFNSNSYRGLIIGRILVGISCGSLIVIIPLFIKEVAPSGWEGLLGSMTQICIRLGVLLTQGIALPLTDSYRWRWILFGSFLIAVLNFFMWFIVDESPKWLLAHGRVTDAKLSLCKLRGVTFDEAAQEIQDWQLQIESGDPLIEPTTTNSISGSNSLWKYLRDRTNVKSRHVITVLLFGQQFCGINSIVLYGTKIISQLYPQHAIRINFFISMVNVLVTILVSLLIHSLPRKPLLMTSTVLVSVTAFIMGIAMNHNKMNLLIVFSFIYMGVFTMGLNPLPFIIMREVSKPQDMVLAQRYGTICNWVGTFIIAYTFPIIHDVLSGYVFIIFAIIACSISAFIWKKVPETKRSG

SEQ ID NO: 135 - DNA, 1842 bp, Saccharomyces cerevisiae
atgaaaggcgaacctaagacttacagcatgagcgacctctcatactacggtgagaaagcacaacaacagaacgagaaacagcaaaaacaatatgttgtgagacgaaattctacgcagtcaacatcaaaacaaaacgtgagcgtggtgctcgaggacaacgccagcgaaagtaatgaactacctaaagggtttatcttgtacgcatctttgatagcattggctttgtcgctgtttctggcagccttggatatcatgatagtttctacaatcattgaagaagtagctaaacagtttggatcgtactctgagatcgggtggttatttaccgggtatagcttaccaaacgctctgttggcgttgatatggggaagaattgccacacctatcggattcaaggagaccatgctatttgctattgtcatttttgaaatcgggtcgctgatctctgctttagcaaattcaatgagtatgctcattggtggtagagttattgctggagtcggcggttgtggtattcaaagtttatcgttcgtcattggttcaaccctggtagaggagtcgcagagaggcatactaattgctgttttgagttgttcgtttgctattgcatctgttgttgggcctttccttggaggagttttcacctccagcgtcacatggagatggtgcttctatgttaatttaccgatcggtggcctagcatttttcttattcctgttcttttataacccaggtttaagtacatttcaagagacaatggataacatccgcaaatttccatcacagtttatcgaaattgttcggaatgtagcatatcatttattgaaaatcaaagggtttagcaaacttaatgggtggagaaagccgttcatggaattgattttcatgtatgatattatcgagtttgtgttttgttcagctggattcacatgtattctattggctttcacatttggcggtaaccggtatgcttggaactctgcatccatcattattcttttcatcatcggtatagtcctggtagtgttagcaggtatctatgatttccttgtcttccccaaatttaatatagtgaaagcaacaccacattaccaaccattaatgtcatggacaaatatcaagaaaccaggtattttcacggttaatatagccttgtttctcacttgtgcaggatatatcagtcagtttacgtatattgtgcaatacttccaattaatttacaatgattccgcctggagagccgctgtacacctggttgcttgcattatttctacagtcgttacagcaatactttgcggtgctatcaccgacaaaacccgccaaatcaaaccgattattgttatttcaagcatttttggtgttgttggtgcgggtatattaaccctattgaacaataatgccaataactctgctcacatcggccttttgatattacctggcgttgctttcggtggtttggcacaaagttccatgctcgcttctcaaattcagttagacaagaagagcccaacttttcgatcagattttgtctctattaccacttttaacacattttgcaaaaatctaggtcaagcactgggaggtgtcatctctaacactgttttcagtgctgctgctatcaagaaattaaccaaggctaatattcagctcccagatggtaccacggtagacaatctggtaatctataggcagaccaatttcgatggctctcattccaaattgggcaatataatttctgaatctctcactgacgtcttttacatggcattaggattttatgcattatctctcatttttgctgtttttgcttcaaataagaaagtcacagcaagcctgagataa

SEQ ID NO: 136 - protein, 613 aa, Saccharomyces cerevisiae
MKGEPKTYSMSDLSYYGEKAQQQNEKQQKQYVVRRNSTQSTSKQNVSVVLEDNASESNELPKGFILYASLIALALSLFLAALDIMIVSTIIEEVAKQFGSYSEIGWLFTGYSLPNALLALIWGRIATPIGFKETMLFAIVIFEIGSLISALANSMSMLIGGRVIAGVGGCGIQSLSFVIGSTLVEESQRGILIAVLSCSFAIASVVGPFLGGVFTSSVTWRWCFYVNLPIGGLAFFLFLFFYNPGLSTFQETMDNIRKFPSQFIEIVRNVAYHLLKIKGFSKLNGWRKPFMELIFMYDIIEFVFCSAGFTCILLAFTFGGNRYAWNSASIIILFIIGIVLVVLAGIYDFLVFPKFNIVKATPHYQPLMSWTNIKKPGIFTVNIALFLTCAGYISQFTYIVQYFQLIYNDSAWRAAVHLVACIISTVVTAILCGAITDKTRQIKPIIVISSIFGVVGAGILTLLNNNANNSAHIGLLILPGVAFGGLAQSSMLASQIQLDKKSPTFRSDFVSITTFNTFCKNLGQALGGVISNTVFSAAAIKKLTKANIQLPDGTTVDNLVIYRQTNFDGSHSKLGNIISESLTDVFYMALGFYALSLIFAVFASNKKVTASLR

SEQ ID NO: 137 - DNA, 1746 bp, Saccharomyces cerevisiae
atgtctaaacaatttagtcataccaccaacgacagaagatcatcgattatctactccaccagtgtcgggaaggcagggcttttcacgcctgcagactacatcccacaggagtcagaagaaaacttaattgagggcgaagagcaagagggtagtgaagaagaaccttcctataccggcaatgacgatgagacggagagggaaggtgaataccattcgttgttagatgccaacaattcgcggacattgcaacaagaagcgtggcaacaaggttatgactctcacgaccgtaagcggttgcttgacgaagaacgggacctgctaatagacaacaaactgctctctcaacacggcaacggtgggggagatatagaaagtcacggacatggccaagcaattggaccggacgaggaagaaagaccagctgagattgcaaatacgtgggagagcgcgatcgagagtggtcagaaaatcagcacaacttttaagagagaaacgcaagtgatcacgatgaatgcgttgccgctaatcttcacctttatcttgcaaaattcgttgtcactagcatctattttctccgtctcacatttagggacgaaagagctaggtggtgttacactcggttctatgactgctaacatcacgggtcttgctgctattcaaggtctgtgtacatgtctggacacactgtgtgcgcaggcatacggtgccaaaaactaccacttggtgggtgtgctagtgcagagatgtgctgtgatcaccatcttggcgttcttgccaatgatgtatgtttggtttgtttggtcggaaaagatcctagcactaatgattccggagagagaactatgcgcgctagcggctaactatctacgtgtaaccgcattcggtgtgccaggattcatcctttttgaatgtggtaagaggttcctacaatgtcaaggtatattccatgcatccacaatcgtgctctttgtgtgcgcacccttgaacgcattgatgaactacttacttgtttggaatgacaagattgggattgggtaccttggtgcgccattatcggttgtgatcaactactggttgatgacgctcggattactaatatacgcaatgaccaccaagcacaaggagagaccactcaaatgctggaatggtatcatccctaaggaacaagcatttaagaactggcgtaagatgattaacctagctattcccggcgtggtgatggtggaggcagagttcctcggctttgaagtgttgacaattttcgcttcccatctgggcaccgatgccttgggcgctcagtcgattgtggctacgattgcgtctcttgcataccaagtgcctttctctatctccgtttctaccagtacacgtgtagccaattttatcggcgcgtcgctatacgacagctgcatgatcacgtgccgcgtgtccttattgttgtcctttgtgtgctcctcaatgaacatgttcgttatctgccgttataaggaacaaatcgcaagtctattttctactgagagcgctgtagtgaagatggtcgtggacacactacctcttcttgcgttcatgcaattattcgatgcctttaatgcgtccaccgccggatgcctacgtggtcaagggagacaaaaaaataggtgggtacatcaacctagtcgcattctactgcctaggtgtgcccatggcatatgtgttagcattcctgtatcatctgggtgtaggcggcttatggttgggtataactag

SEQ ID NO: 138 - protein, 581 aa, Saccharomyces cerevisiae
MSKQFSHTTNDRRSSIIYSTSVGKAGLFTPADYIPQESEENLIEGEEQEGSEEEPSYTGNDDETEREGEYHSLLDANNSRTLQQEAWQQGYDSHDRKRLLDEERDLLIDNKLLSQHGNGGGDIESHGHGQAIGPDEEERPAEIANTWESAIESGQKISTTFKRETQVITMNALPLIFTFILQNSLSLASIFSVSHLGTKELGGVTLGSMTANITGLAAIQGLCTCLDTLCAQAYGAKNYHLVGVLVQRCAVITILAFLPMMYVWFVWSEKILALMIPERELCALAANYLRVTAFGVPGFILFECGKRFLQCQGIFHASTIVLFVCAPLNALMNYLLVWNDKIGIGYLGAPLSVVINYWLMTLGLLIYAMTTKHKERPLKCWNGIIPKEQAFKNWRKMINLAIPGVVMVEAEFLGFEVLTIFASHLGTDALGAQSIVATIASLAYQVPFSISVSTSTRVANFIGASLYDSCMITCRVSLLLSFVCSSMNMFVICRYKEQIASLFSTESAVVKMVVDTLPLLAFMQLFDAFNASTAGCLRGQGRQKNRWVHQPSRILLPRCAHGICVSIPVSSGCRRLMVGYN

SEQ ID NO: 139 - DNA, 1305 bp, Saccharomyces cerevisiae
atgaagactcagtactctctaatacgaaaaatttgggcacattcagtaacagaatttctgaaatcccagtggtttttcatctgtttggctattttaatcgttattgcaagatttgctccgaattttgcaagagacggagggttaattaaaggccaatatagtattgggtacggctgcgtcgcctggatttttctccaaagtggcctgggaatgaaatcaaggtcactaatggcaaatatgttaaattggagagctcatgccactattctggttctgagtttccttattacctcgtccatagtatatggattttgttgcgcggtaaaggctgctaatgatccgaaaatagatgactgggtacttatcggtctaattttgactgccacttgtccaacaaccgtggcttcaaacgttatcatgactacgaatgcaggtggaaatagccttttgtgcgtttgtgaagtattcattggaaatttgttgggtgcgtttattacacctgcattggttcaaatgtttactaaccgcgcaccatttgcatacggcaaccctgccactggaaatggcattggtgcgctttatggccgtgttatgaaacaggttggtctctctgtattcgtacccttgtttgtgggtcaggttattcaaaattgctttccgaagggtactgcttattacctgggctttttgaaaaaataccatattaaaattggatcttacatgcttttattgattatgtttagttcattctcaactgccttttatcaggatgcgtttactagcgtttctcatgtttgcatcatatttctctgcttttttaatttgggaatttatatattcttcacgggtctgtcatacttatgtgcaaggccatggttcatcctcaagcttttccctcatgaaccaatagagggcaaatctacaagattgtaccgctattcgtataatatctttaggcctttttattattcaaaggaagatgcgatttgcattatgttttgtggcccggctaaaactgcagcactgggtgtatcactaattacttcacaatacggcgataaaaaagaacacctgggtaagttgttggttcccttggttttatatcaagttgagcaagtcatgacggcaaatttctttgtaagcttgttcaaaagatggatacaaaaggacgctcaagcagacggaagcgagtcatcttgtgcaaatgagaatgaggaagttgatttggaaaagatcatatcaattggaactggtgaaaatcaatccgttctgtcgaacaacgtcccatatacacaaccaaggtga

SEQ ID NO: 140 - protein, 434 aa, Saccharomyces cerevisiae
MKTQYSLIRKIWAHSVTEFLKSQWFFICLAILIVIARFAPNFARDGGLIKGQYSIGYGCVAWIFLQSGLGMKSRSLMANMLNWRAHATILVLSFLITSSIVYGFCCAVKAANDPKIDDWVLIGLILTATCPTTVASNVIMTTNAGGNSLLCVCEVFIGNLLGAFITPALVQMFTNRAPFAYGNPATGNGIGALYGRVMKQVGLSVFVPLFVGQVIQNCFPKGTAYYLGFLKKYHIKIGSYMLLLIMFSSFSTAFYQDAFTSVSHVCIIFLCFFNLGIYIFFTGLSYLCARPWFILKLFPHEPIEGKSTRLYRYSYNIFRPFYYSKEDAICIMFCGPAKTAALGVSLITSQYGDKKEHLGKLLVPLVLYQVEQVMTANFFVSLFKRWIQKDAQADGSESSCANENEEVDLEKIISIGTGENQSVLSNNVPYTQPR

SEQ ID NO: 141 - DNA, 1761 bp, Saccharomyces cerevisiae
atggacaaatataccaacagggatcatccggactatattcctggcacatttaacatctattcttcccaaaatttggaaaatggtattatatacgaatcaaaattgaagaaaacctcctcaggagtcgtcctaatccctcaaccatcatactcgccaaatgatccactgaactggtctagctggaggaaattggctcattttggtctaatggcctttataactgcgtttaccgccgctactagtaacgacgctggtgctgctcaagactcattgaatgagatttatgggatatcctacgattccatgaacacaggggctggtgttcttttcctaggtattggttggtccactttattcttggctccatttgctaacttgtatggcaggaagattacgtacatagtttgcaccacattaggtctctttggtgcgctttggtttgctttggccaaaagaacgagcgacacaatatggtctcagttgtttgtaggtattagtgagtcctgtgctgaagcccaggtgcaactgtccctgagcgacatttttttccagcaccaattgggctccgtattgaccgtgtatatcatgtgcactagtatcggtacgttcttgggcccattgatcgctgggtacatatctgcatttaccaacttccgttgggtcggttgggtcgcagtgatcatatctggtggccttttaataactattatatttggctgcgaagaaacgtacttcgacagaggccagtatatgacccctttgaccagctgtcaatcgggatacgaagacggtaccactttacaaaactctgacaatacggccgtgtcgcgcaggaaacgtcatcttgacgctaaattatcaactcctggagccatgggtgagaaaggtgtagacctttcagagacggctgaattcgaagttaacaatgaagaggaagttaccatacctgagactcgcgaattgattgatggttcaaaagagcatttgaaaccatacccaaaaagagtagcaatattaaccaaagctactaatttgaaaggctacggttttaaacagtatttcaaatatctaaagatcaaccttagaatgttcttattcccgccagtgtggttgtctggtatgttttggggtattcaagacgttttcctgacgttttatttgaccactcaagaaagcgcctactacgaacctccatggaactatagtgattttggtgtcgcaattatgaatgttcccacacttattggagcagtcatcggttgtatctgtgctggcattgttagtgactactttgttctttggatggctcgtcacaatagaggaattttagaggcagaatttagactatacttctctatcgcaactgcaattattgggccagcgggtttgctgatgtttggtatcggtaccgctagacaatggccttggcaagctatatacgtcgggttgggttttgttgggtttgcatggggttgttctggtgatattgcgatggcgtatttaatggattgttaccccgatatggttttggaaggtatggtttgtactgctattattaacaacacgatatcttgcattttcacctttacctgttctgattggctagctgcatctggtactgaaaatacttacattgctttagctgtcatcaactttgggattactgcatttgctttaccaatgtactactatggtaagaggataagactttggactaagagatggtatttgcaatctgtcaatttgagagacggtgtgtaa

SEQ ID NO: 142 - protein, 586 aa, Saccharomyces cerevisiae
MDKYTNRDHPDYIPGTFNIYSSQNLENGIIYESKLKKTSSGVVLIPQPSYSPNDPLNWSSWRKLAHFGLMAFITAFTAATSNDAGAAQDSLNEIYGISYDSMNTGAGVLFLGIGWSTLFLAPFANLYGRKITYIVCTTLGLFGALWFALAKRTSDTIWSQLFVGISESCAEAQVQLSLSDIFFQHQLGSVLTVYIMCTSIGTFLGPLIAGYISAFTNFRWVGWVAVIISGGLLITIIFGCEETYFDRGQYMTPLTSCQSGYEDGTTLQNSDNTAVSRRKRHLDAKLSTPGAMGEKGVDLSETAEFEVNNEEEVTIPETRELIDGSKEHLKPYPKRVAILTKATNLKGYGFKQYFKYLKINLRMFLFPPVWLSGMFWGIQDVFLTFYLTTQESAYYEPPWNYSDFGVAIMNVPTLIGAVIGCICAGIVSDYFVLWMARHNRGILEAEFRLYFSIATAIIGPAGLLMFGIGTARQWPWQAIYVGLGFVGFAWGCSGDIAMAYLMDCYPDMVLEGMVCTAIINNTISCIFTFTCSDWLAASGTENTYIALAVINFGITAFALPMYYYGKRIRLWTKRWYLQSVNLRDGV

SEQ ID NO: 143 - DNA, 1779 bp, Saccharomyces cerevisiae
atgaccgaagactttatttcttctgtcaagcgttcaaatgaggagctgaaggagcgaaaatctaactttggatttgtagaatacaaatccaagcaattaacatcatcctcatcacacaattcaaactcatcgcatcacgatgatgacaaccaacacggcaagaggaatattttccagcgatgtgttgattctttcaagtctcctctggacggctcgttcgacacaagtaatttgaagaggactctgaaaccaaggcacttaatcatgattgccattgggggcagtataggtactggtttgtttgtcggtagtggtaaggcaatcgccgaaggtggtcctcttggtgtcgtcattggttgggctattgcaggctctcaaatcatcgggacgattcatgggctaggtgaaatcacggtgcggttccccgttgtcggggcctttgccaattacggcacaaggtttttggatccaagtataagttttgttgtttcgaccatatacgtgctacagtggttttttgtattacccttagaaatcattgcggcggcaatgaccgtacagtactggaactcgtctattgaccccgtaatttgggtagccatcttttatgctgttattgtttccataaatttgtttggtgtacgaggttttggggaagcggaatttgcattttccaccataaaagcaataacagtttgcggattcattatattgtgcgttgtcctcatttgcggtggaggtcccgaccacgagttcattggcgccaaatactggcacgaccctggttgtttggccaatgggttcccgggcgttctatctgttcttgttgttgcttcgtattctctcggtggtatagaaatgacgtgcctggcatcaggtgaaacggaccccaaaggcttaccaagtgctatcaagcaagtgttttggaggatcttatttttctttttgatatcactgaccctggtaggattcctggttccatatacaaaccaaaacttactgggtggttcatctgtggacaactcaccttttgtcattgccataaaattgcatcacattaaagccttgccctccatcgtcaatgcggtcatccttatcagtgttttgagtgtaggtaactcctgcatcttcgcttcaagtagaacgttgtgttcgatggcccaccaaggccttattccatggtggtttggttatatcgaccgtgctggtaggccactggttggcattatggcaaattcactatttggattactagcatttctggtcaaatctggctcgatgtctgaagttttcaattggttaatggccattgccggcctggccacgtgcattgtctggttgagcatcaacctgtcacatatcagatttagactggcgatgaaggctcaagggaagtctctggatgaattagaatttgttagtgctgtcgggatttggggatcagcgtattccgctttaatcaactgtctaatcttgatagctcaattctattgttcactatggcccattggtggctggaccagcggcaaagaaagggctaaaatattttttcaaaattatctgtgtgccttaatcatgttatttatattcatcgtccacaaaatttattacaagtgtcaaacaggcaaatggtggggggttaaggcgttaaaggacatagatttggaaaccgatcgtaaagatatcgacatcgaaatagtcaagcaagaaattgccgaaaagaaaatgtacctagattcccgtccatggtacgtgagacagttccatttctggtgttaa

SEQ ID NO: 144 - protein, 592 aa, Saccharomyces cerevisiae
MTEDFISSVKRSNEELKERKSNFGFVEYKSKQLTSSSSHNSNSSHHDDDNQHGKRNIFQRCVDSFKSPLDGSFDTSNLKRTLKPRHLIMIAIGGSIGTGLFVGSGKAIAEGGPLGVVIGWAIAGSQIIGTIHGLGEITVRFPVVGAFANYGTRFLDPSISFVVSTIYVLQWFFVLPLEIIAAAMTVQYWNSSIDPVIWVAIFYAVIVSINLFGVRGFGEAEFAFSTIKAITVCGFIILCVVLICGGGPDHEFIGAKYWHDPGCLANGFPGVLSVLVVASYSLGGIEMTCLASGETDPKGLPSAIKQVFWRILFFFLISLTLVGFLVPYTNQNLLGGSSVDNSPFVIAIKLHHIKALPSIVNAVILISVLSVGNSCIFASSRTLCSMAHQGLIPWWFGYIDRAGRPLVGIMANSLFGLLAFLVKSGSMSEVFNWLMAIAGLATCIVWLSINLSHIRFRLAMKAQGKSLDELEFVSAVGIWGSAYSALINCLILIAQFYCSLWPIGGWTSGKERAKIFFQNYLCALIMLFIFIVHKIYYKCQTGKWWGVKALKDIDLETDRKDIDIEIVKQEIAEKKMYLDSRPWYVRQFHFWC

SEQ ID NO: 145 - DNA, 3885 bp, Saccharomyces cerevisiae
atgtcacagcaggagaatggtgatgtggccactgaattaatcgaaaatagactttccttctcaagaatccctagaataagccttcatgtaagggatttgtcaatcgttgcatccaaaacaaatacgacgctagttaatacgttttccatggacctgcccagtgggtcggtcatggcagttatgggtggttcggggtcagggaagactacgttgctgaatgttctggcatccaagatcagtggtgggttaactcataatggttctatacggtacgtattggaagatacaggttcagaacccaatgaaacagagcctaagagggctcacttggatggccaagaccatcccatccagaaacacgtaataatggcgtacctacctcaacaagatgtactctctcctaggttgacttgtagagaaactcttaagtttgcagctgatttgaaactaaactcttctgagcgaaccaagaaattaatggtcgagcaattaattgaagaattagggctcaaggattgtgccgatactcttgtgggggacaactcgcacaggggtctttctggtggtgaaaagagaagactaagtattggtactcaaatgatttcaaacccttccatcatgttcttagatgagcctaccactggactggatgcatattctgccttcttggttattaaaactttgaaaaaattagctaaagaagatggcaggacttttatcatgtcaattcatcagccgagatcggatatattgtttttattggaccaggtttgtattttgtcaaagggaaatgtggtatattgtgacaaaatggataatactatcccttattttgagtctattggttatcacgtaccccagctggtaaatccagcagattatttcattgatttatcaagcgtagactctagatctgataaagaagaagctgccacgcaaagtcggctaaattcattgattgatcattggcatgattatgagagaactcatttgcaactacaggcagaatcttatataagcaacgcaacggaaattcaaattcagaatatgactaccagactgccattttggaagcaagttacggtgctaacaaggcgaaatttcaaattaaatttttcagattacgttactttaatatctacttttgcagaaccgttgattattggtactgtttgcggttggatttactataaacctgacaaaagcagtataggtggtttaaggacaacaaccgcatgtctttacgcgtccacaattttgcaatgttacttgtatttgctttttgatacttatcgactttgtgagcaggatattgcgttatatgacagagaaagagcagagggctcggtaacacctttggcattcatcgtagctagaaaaatttcacttttcctctctgacgatttcgcgatgaccatgatttttgtcagtataacatattttatgtttggattggaagcagatgcaaggaagtttttttatcagtttgctgttgtatttttatgtcagctatcatgttccggtttatctatgttatcggtggcggtatcgagagatttttctaaagcttcattagtaggaaatatgacatttacggtattatcgatgggatgtggttttttcgttaatgctaaagtaatgcccgtgtatgttcgttggattaaatatattgcctttacgtggtattcattcggtactctcatgtcaagcacctttacgaattcgtactgtactacagataatctcgatgagtgcttgggtaaccagatattggaagtttacgggtttcctaggaattggataaccgtacctgccgttgtcttactttgctggtctgtgggatattttgtagtaggtgcaattattttatatttgcacaagattgatataactttacaaaatgaagtgaaatcgaagcaaaaaaaaatcaaaaagaaatccccaacaggaatgaaacccgagattcagctgctagatgacgtgtatcatcagaaagatttggaagcggagaaaggaaaaaatatacatattactataaaattagaagatatagacttacgagtcattttttctgcccctttctcaaactggaaagaaggcaacttccaccatgaaacaaaagaaattctacaatcagttaatgccattttcaaacctggaatgattaatgcaattatggggccatcagggtctggaaagtcttctctgttaaacctaatctccggaagattaaaatcttcggtctttgccaaatttgacacttcaggttcaataatgttcaatgatattcaagtttcagagcttatgtttaaaaatgtatgctcgtatgtctcgcaggatgatgaccaccttttggcagctttaaccgttaaagaaaccctgaaatatgccgctgcattaagattgcatcatctgactgaggcagaacgaatggagagaactgacaacctaataaggtctttgggtttaaagcattgtgaaaacaatatcattggtaatgaatttgttaaaggtataagcggtggtgaaaaaagaagagtaactatgggtgtgcaattattaaacgatcctccgatattattgctagatgaaccaacttcagggttagatagcttcacatccgctactatactggaaattttggagaagttatgtagggaacagggcaagacgatcatcattaccattcatcaaccaaggtcagaattattcaagagatttggtaatgttttgctattagctaaatcgggtagaactgctttcaatggatcaccagatgaaatgattgcttatttcactgaattgggatataactgtccttcgtttacgaacgtggcagatttctttcttgatttaatttcagttaatacccagaacgaacagaatgaaataagctcaagggcacgagtagaaaagatacttagtgcatggaaagctaatatggataacgaaagcctttcaccaaccccaatttctgaaaaacaacaatactctcaggagtcatttttcacagaatacagcgagtttgtaagaaaaccagctaatttggttttggcgtacatagtgaacgttaaaaggcaatttactacgacaaggagaagttttgactctttgatggcgcgtattgcacaaattccaggattaggtgttattttcgcattattctttgccccagtcaagcataattatacaagtattagcaatcgtctaggattggcacaagaatctacagcactatattttgtgggcatgctggggaacttggcatgttatccaactgaaagagattacttttacgaagaatataatgataatgtttatggtatagcaccttttttcttagcttatatgacattagagttgccgctatccgcattagcttcagtgttatacgcggtatttacagtactggcatgtgggttaccaagaactgcaggcaacttctttgcaaccgtctactgttcctttattgttacctgttgtggcgaagctcttggtataatgacaaatacatttttcgaaaggccaggcttcgtcgttaactgcatttccattattttatccattggtactcagatgtcagggttaatgtcactaggcatgtcgagagtattaaagggttttaactatttgaaccctgtagggtatacatctatgatcatcattaatttcgcattcccaggtaatttgaaattaacctgcgaagatggcgggaaaaattcagacggtacttgtgaatttgcgaatggccatgatgtgttggtttcttatggtttagtcagaaatacgcaaaagtacctgggaatcattgtgtgcgtagccataatttatcgccttattgcattttttattttaaaagcaaaattggagtggataaaatggtga

SEQ ID NO: 146 - protein, 1294 aa, Saccharomyces cerevisiae
MSQQENGDVATELIENRLSFSRIPRISLHVRDLSIVASKTNTTLVNTFSMDLPSGSVMAVMGGSGSGKTTLLNVLASKISGGLTHNGSIRYVLEDTGSEPNETEPKRAHLDGQDHPIQKHVIMAYLPQQDVLSPRLTCRETLKFAADLKLNSSERTKKLMVEQLIEELGLKDCADTLVGDNSHRGLSGGEKRRLSIGTQMISNPSIMFLDEPTTGLDAYSAFLVIKTLKKLAKEDGRTFIMSIHQPRSDILFLLDQVCILSKGNVVYCDKMDNTIPYFESIGYHVPQLVNPADYFIDLSSVDSRSDKEEAATQSRLNSLIDHWHDYERTHLQLQAESYISNATEIQIQNMTTRLPFWKQVTVLTRRNFKLNFSDYVTLISTFAEPLIIGTVCGWIYYKPDKSSIGGLRTTTACLYASTILQCYLYLLFDTYRLCEQDIALYDRERAEGSVTPLAFIVARKISLFLSDDFAMTMIFVSITYFMFGLEADARKFFYQFAVVFLCQLSCSGLSMLSVAVSRDFSKASLVGNMTFTVLSMGCGFFVNAKVMPVYVRWIKYIAFTWYSFGTLMSSTFTNSYCTTDNLDECLGNQILEVYGFPRNWITVPAVVLLCWSVGYFVVGAIILYLHKIDITLQNEVKSKQKKIKKKSPTGMKPEIQLLDDVYHQKDLEAEKGKNIHITIKLEDIDLRVIFSAPFSNWKEGNFHHETKEILQSVNAIFKPGMINAIMGPSGSGKSSLLNLISGRLKSSVFAKFDTSGSIMFNDIQVSELMFKNVCSYVSQDDDHLLAALTVKETLKYAAALRLHHLTEAERMERTDNLIRSLGLKHCENNIIGNEFVKGISGGEKRRVTMGVQLLNDPPILLLDEPTSGLDSFTSATILEILEKLCREQGKTIIITIHQPRSELFKRFGNVLLLAKSGRTAFNGSPDEMIAYFTELGYNCPSFTNVADFFLDLISVNTQNEQNEISSRARVEKILSAWKANMDNESLSPTPISEKQQYSQESFFTEYSEFVRKPANLVLAYIVNVKRQFTTTRRSFDSLMARIAQIPGLGVIFALFFAPVKHNYTSISNRLGLAQESTALYFVGMLGNLACYPTERDYFYEEYNDNVYGIAPFFLAYMTLELPLSALASVLYAVFTVLACGLPRTAGNFFATVYCSFIVTCCGEALGIMTNTFFERPGFVVNCISIILSIGTQMSGLMSLGMSRVLKGFNYLNPVGYTSMIIINFAFPGNLKLTCEDGGKNSDGTCEFANGHDVLVSYGLVRNTQKYLGIIVCVAIIYRLIAFFILKAKLEWIKW

SEQ ID NO: 147 - DNA, 1461 bp, Saccharomyces cerevisiae
atgcctctatcaaaggtggagcactacctttcataccatacgcgcttactcttaccccatgttttgtctcttcagtcatcacatcgtgttgcatacatcttttcgctattatctgcggtgtcaactggcttcattactttgatatctctttactctcaaccgtggcagaaacatttaaattattcctcatggcaaatcaacaccatcgctagtatgactaatttggggatgtacttgacgccaccaatcttggggatgatcgctgattctcatggccccattactttaagtcttttagccatcatagggttcatacctagctattcatatctggcttacgtttttaatcatccggagttatctctcggaggaaatggtgactcatcattcaatctatccatcatttgtttcgttttcataggtatatcaacaagcgctttatactttagcgctttactgacatgcactaagctatatcctcatacaaaactactatccattagcttaccaacgacatgttatggtatttcttctgtagtcggttctcaactgctaagaatcaaatggttctggtcctctaacgcaagttcttcctcgtccaatagtgacttaaacctgggaagagtattccaaacatttgccctcgtttatgtcgttattgggctacttgcatggatagccaccagcgtggtatcacttttgcattttaatgaagagcaagacaaccaaaaacggctggatgatcaaactgatgtggaacaatcaccgctgttagaacgaagtaatcatgttcaagaaaagtttacgcagacgatgctaaggatctttagtgatcctgtgacatatatcctagcggtatcaattttgttatcacttgggcccctcgagatgtttattgccaatatgggatcactgactaacctgctagtccaattagatgcgccaaccttatctacaaagttgttatccacatacgcgctatcttccacttttacgagattgctcacaggcatagtggcagacttcttcgccaagaaaaaaatatcaattaaatggatcctgttgactttcctttcattaggggtatgtgcacaactgtttttattgaaaatgacctcttcagcgtcaccctgggggctagtacctacaggatcattggttggaattgtatacggtggacttttcactgtttatccgacgctggtcctgttagtatggggcgaacgctcattcgggactgtttacggtagcttactaattgcacctgctataggttctatgatattttgcatgttgtatgccaaattttacgattctcgctgtatgagtggcggaggagatctgcgaaatccgtcctgtatttcggctgtctacaagtacagcagtatcgcattcgttgtatccgctgttctttcagctgtagtattttggaaattaaaaagtagaaaactcagaatttaa

SEQ ID NO: 148 - protein, 486 aa, Saccharomyces cerevisiae
MPLSKVEHYLSYHTRLLLPHVLSLQSSHRVAYIFSLLSAVSTGFITLISLYSQPWQKHLNYSSWQINTIASMTNLGMYLTPPILGMIADSHGPITLSLLAIIGFIPSYSYLAYVFNHPELSLGGNGDSSFNLSIICFVFIGISTSALYFSALLTCTKLYPHTKLLSISLPTTCYGISSVVGSQLLRIKWFWSSNASSSSSNSDLNLGRVFQTFALVYVVIGLLAWIATSVVSLLHFNEEQDNQKRLDDQTDVEQSPLLERSNHVQEKFTQTMLRIFSDPVTYILAVSILLSLGPLEMFIANMGSLTNLLVQLDAPTLSTKLLSTYALSSTFTRLLTGIVADFFAKKKISIKWILLTFLSLGVCAQLFLLKMTSSASPWGLVPTGSLVGIVYGGLFTVYPTLVLLVWGERSFGTVYGSLLIAPAIGSMIFCMLYAKFYDSRCMSGGGDLRNPSCISAVYKYSSIAFVVSAVLSAVVFWKLKSRKLRI

SEQ ID NO: 149 - DNA, 1236 bp, Saccharomyces cerevisiae
atggatgcaactaccccactattaactgttgcgaacagtcatcccgcccgcaatccaaagcacactgcatggagagcagctgtgtatgatttacagtatattttgaaagcgtcacccctgaatttcctattggtatttgttcctttaggtctgatttggggacacttccaactatctcatacactgacatttctttttaatttcttggcaattataccgttggcagctatcttggctaatgccacggaagagttggctgataaggctggtaacaccattgggggactgctaaatgctacttttggtaacgctgtggaactaattgtttctatcattgccctgaaaaaaggtcaagtgagaattgtgcaggcctcgatgctaggtagtcttctttctaatttgctgttagtgcttggattatgcttcatattcggtggatacaatagagtccaacagacattcaaccaaaccgccgctcaaacaatgtcctcattacttgccattgcgtgtgcatccctactgattcccgctgcctttagagccaccctacctcatggcaaggaagaccacttcatcgatggaaaaatattggagttatccagaggcacctctattgttattctcatcgtttacgttttgttcttatatttccagctagggagccatcacgccttgtttgagcaacaagaagaagagaccgatgaagttatgagcaccatttccaggaatccacatcactctttgagtgtcaagtcatcattggtgatacttctaggtacaactgtgatcatctctttttgtgcggattttctagtcggtacgatagacaacgttgttgaatctaccgggctatctaaaacatttataggtttgattgtcattcctattgtgggtaatgccgcagagcatgtcacttcagtcttggtggccatgaaggataagatggatctggcgctaggtgttgccatcggttcctctttacaagttgccttatttgttacaccattcatggttcttgtgggctggatgatcgatgttccaatgacgctaaatttctccacttttgaaaccgctactctttttattgctgttttcttatccaattacttaattctcgatggtgagtcaaactggttggagggtgtcatgtctctagctatgtatattttgattgcaatggcatttttctattatccagacgaaaaaacccttgactctattggaaatagtttatga

SEQ ID NO: 150 - protein, 411 aa, Saccharomyces cerevisiae
MDATTPLLTVANSHPARNPKHTAWRAAVYDLQYILKASPLNFLLVFVPLGLIWGHFQLSHTLTFLFNFLAIIPLAAILANATEELADKAGNTIGGLLNATFGNAVELIVSIIALKKGQVRIVQASMLGSLLSNLLLVLGLCFIFGGYNRVQQTFNQTAAQTMSSLLAIACASLLIPAAFRATLPHGKEDHFIDGKILELSRGTSIVILIVYVLFLYFQLGSHHALFEQQEEETDEVMSTISRNPHHSLSVKSSLVILLGTTVIISFCADFLVGTIDNVVESTGLSKTFIGLIVIPIVGNAAEHVTSVLVAMKDKMDLALGVAIGSSLQVALFVTPFMVLVGWMIDVPMTLNFSTFETATLFIAVFLSNYLILDGESNWLEGVMSLAMYILIAMAFFYYPDEKTLDSIGNSL

SEQ ID NO: 151 - DNA, 1710 bp, Saccharomyces cerevisiae
atgaaggatttaaaattatcgaatttcaaaggcaaatttataagcagaaccagtcactggggacttacgggtaagaagttgcggtatttcatcactatcgcatctatgacgggcttctccctgtttggatacgaccaagggttgatggcaagtctaattactggtaaacagttcaactatgaatttccagcaaccaaagaaaatggcgatcatgacagacacgcaactgtagtgcagggcgctacaacctcctgttatgaattaggttgtttcgcaggttctctattcgttatgttctgcggtgaaagaattggtagaaaaccattaatcctgatgggttccgtaataaccatcattggtgccgttatttctacatgcgcatttcgtggttactgggcattaggccagtttatcatcggaagagtcgtcaccggtgttggaacagggttgaatacatctactattcccgtttggcaatcagaaatgtcaaaagctgaaaatagagggttgctggtcaatttagaaggttccacaattgcttttggtactatgattgcttattggattgattttgggttgtcttataccaacagttctgttcagtggagattccccgtgtcaatgcaaatcgtttttgctctcttcctgcttgctttcatgattaaactacctgaatcgccacgttggctgatttctcaaagtcgaacagaagaagctcgctacttggtaggaacactagacgacgcggatccaaatgatgaggaagttataacagaagttgctatgcttcacgatgctgttaacaggaccaaacacgagaaacattcactgtcaagtttgttctccagaggcaggtcccaaaatcttcagagggctttgattgcagcttcaacgcaatttttccagcaatttactggttgtaacgctgccatatactactctactgtattattcaacaaaacaattaaattagactatagattatcaatgatcataggtggggtcttcgcaacaatctacgccttatctactattggttcattttttctaattgaaaagctaggtagacgtaagctgtttttattaggtgccacaggtcaagcagtttcattcacaattacatttgcatgcttggtcaaagaaaataaagaaaacgcaagaggtgctgccgtcggcttatttttgttcattacattctttggtttgtctttgctatcattaccatggatatacccaccagaaattgcatcaatgaaagttcgtgcatcaacaaacgctttctccacatgtactaattggttgtgtaactttgcggttgtcatgttcaccccaatatttattggacagtccggttggggttgctacttattttttgctgttatgaattatttatacattccagttatcttctttttctaccctgaaaccgccggaagaagtttggaggaaatcgacatcatctttgctaaagcatacgaggatggcactcaaccatggagagttgctaaccatttgcccaagttatccctacaagaagtcgaagatcatgccaatgcattgggctcttatgacgacgaaatggaaaaagaggactttggtgaagatagagtagaagacacctataaccaaattaacggcgataattcgtctagttcttcaaacatcaaaaatgaagatacagtgaacgataaagcaaattttgagggttga

SEQ ID NO: 152 - protein, 569 aa, Saccharomyces cerevisiae
MKDLKLSNFKGKFISRTSHWGLTGKKLRYFITIASMTGFSLFGYDQGLMASLITGKQFNYEFPATKENGDHDRHATVVQGATTSCYELGCFAGSLFVMFCGERIGRKPLILMGSVITIIGAVISTCAFRGYWALGQFIIGRVVTGVGTGLNTSTIPVWQSEMSKAENRGLLVNLEGSTIAFGTMIAYWIDFGLSYTNSSVQWRFPVSMQIVFALFLLAFMIKLPESPRWLISQSRTEEARYLVGTLDDADPNDEEVITEVAMLHDAVNRTKHEKHSLSSLFSRGRSQNLQRALIAASTQFFQQFTGCNAAIYYSTVLFNKTIKLDYRLSMIIGGVFATIYALSTIGSFFLIEKLGRRKLFLLGATGQAVSFTITFACLVKENKENARGAAVGLFLFITFFGLSLLSLPWIYPPEIASMKVRASTNAFSTCTNWLCNFAVVMFTPIFIGQSGWGCYLFFAVMNYLYIPVIFFFYPETAGRSLEEIDIIFAKAYEDGTQPWRVANHLPKLSLQEVEDHANALGSYDDEMEKEDFGEDRVEDTYNQINGDNSSSSSNIKNEDTVNDKANFEG

SEQ ID NO: 153 - DNA, 2853 bp, Saccharomyces cerevisiae
atgagtgacaatccatttaatgcgagtcttcttgacgaggactcaaaccgtgagagagaaatactagatgccacagcagaggccctttcgaaaccaagcccttctttagagtattgtactttatccgtggacgaagctctagaaaaactggacactgacaaaaacggtggtttacgatcatctaacgaggccaacaataggagatcactttatggccccaatgaaataaccgtagaagatgatgaaagtcttttcaagaagttcttgtcaaatttcattgaggatcgaatgattctacttttaataggatccgcagtggtctctctttttatgggtaacattgatgatgctgttagtatcacactggccattttcatagttgtcactgtcggttttgtccaagaatataggtctgaaaaatctctagaagcgttgaataaattggttcctgctgaatgtcacttaatgagatgtggtcaagagagtcatgtactggcttccaccttggttcctggtgatttagtgcacttcagaataggtgacagaatccccgcagacattagaattattgaagcaatcgatttatccatcgatgaaagtaatttaactggtgaaaatgaaccggtacataaaacctcacaaacgatcgaaaaatcttcctttaacgatcagcctaattcaattgtaccgatttctgagagatcttgtatagcttatatgggtacattagtcaaggaaggtcatggtaagggtatcgtcgtaggaacaggtacaaacacatcctttggtgccgtttttgaaatgatgaataatattgaaaaaccgaagactccattgcagttaacaatggacaaattgggaaaggacttgtcactggttagcttcatagttattggtatgatttgtttagttggtatcatacaaggtagatcttggttagaaatgttccaaatatcggtatccttagcggttgctgctattccagaagggttaccaattattgtcactgttactttggcattgggtgttctgagaatggccaagcgtaaagccatcgtgagaaggttaccaagtgtcgaaactttaggctctgtcaacgttatctgctccgacaaaacaggtacactaacctcaaaccacatgaccgtatctaaactttggtgcttggacagtatgtccaataagctaaacgtcctctcattagacaaaaataagaagactaaaaattctaatggaaatttgaaaaactatttgactgaagacgttagggaaactctaactatcggtaatctctgtaataatgcatctttctctcaagaacatgccatatttctgggaaatcctactgatgtagctcttttagagcaattggcaaactttgaaatgcctgatatcagaaacaccgttcaaaaagttcaggaacttccatttaactcgaaaagaaaattaatggcaaccaagattctcaaccctgtcgacaataagtgtacagtttatgttaaaggtgcatttgaaagaattcttgagtactccacaagttatttgaaatcaaagggtaaaaaaactgaaaagttgactgaagcccaaaaagctacgataaatgagtgcgcaaattctatggcatctgaaggtttgcgtgtctttggatttgctaaactaactttgtctgattcatcaactcctctaaccgaagacctaatcaaagatttaacctttactggtttaatcggtatgaatgacccaccaagaccgaacgttaaatttgccatcgaacaattactacaaggtggtgtccatattattatgatcactggtgattctgagaataccgcagtaaacattgcaaaacaaattggtattccagttattgatccaaagctttccgttttatccggtgataaattagatgaaatgtcagatgatcaactggccaatgtcatcgaccacgttaatatttttgctcgtgctacgcctgagcataagttaaacattgttcgtgcattaagaaagaggggtgatgtggtagcaatgactggtgatggtgttaacgacgctcctgcgttgaaactttcagatattggtgtttctatgggtagaattggtacagatgtagccaaagaagcctcagatatggtcttaactgatgatgacttcagtactattttaactgccattgaagagggtaaaggtatctttaataatattcagaatttcctgacttttcaattgtctacttctgttgccgcactatcattagttgcactatctacagcgtttaaactacccaatccactgaacgcaatgcaaattctttggataaatattttaatggatgggccaccagctcaatccttaggtgtggaacctgttgatcatgaagttatgaaaaaacctccaagaaaacgtaccgataaaattttgacccatgatgtaatgaaacgtttactaaccaccgcggcctgtatcatcgttgggacagtttacatttttgttaaagagatggccgaagatggtaaagtaactgctagagatactactatgacatttacttgttttgttttttttgatatgtttaatgctttggcctgcagacataacacaaagtcaatcttcgaaatcggctttttcacgaacaaaatgttcaactacgccgttggactgtctctgttaggtcaaatgtgcgctatatatataccatttttccaaagtatctttaaaactgagaaacttggtatctctgatatactattgttattgctcatcagcagtagcgttttcatcgttgatgaattgagaaaattgtggacgaggaaaaagaatgaagaagactcaacgtatttctcaaatgtttga

SEQ ID NO: 154 - protein, 950 aa, Saccharomyces cerevisiae
MSDNPFNASLLDEDSNREREILDATAEALSKPSPSLEYCTLSVDEALEKLDTDKNGGLRSSNEANNRRSLYGPNEITVEDDESLFKKFLSNFIEDRMILLLIGSAVVSLFMGNIDDAVSITLAIFIVVTVGFVQEYRSEKSLEALNKLVPAECHLMRCGQESHVLASTLVPGDLVHFRIGDRIPADIRIIEAIDLSIDESNLTGENEPVHKTSQTIEKSSFNDQPNSIVPISERSCIAYMGTLVKEGHGKGIVVGTGTNTSFGAVFEMMNNIEKPKTPLQLTMDKLGKDLSLVSFIVIGMICLVGIIQGRSWLEMFQISVSLAVAAIPEGLPIIVTVTLALGVLRMAKRKAIVRRLPSVETLGSVNVICSDKTGTLTSNHMTVSKLWCLDSMSNKLNVLSLDKNKKTKNSNGNLKNYLTEDVRETLTIGNLCNNASFSQEHAIFLGNPTDVALLEQLANFEMPDIRNTVQKVQELPFNSKRKLMATKILNPVDNKCTVYVKGAFERILEYSTSYLKSKGKKTEKLTEAQKATINECANSMASEGLRVFGFAKLTLSDSSTPLTEDLIKDLTFTGLIGMNDPPRPNVKFAIEQLLQGGVHIIMITGDSENTAVNIAKQIGIPVIDPKLSVLSGDKLDEMSDDQLANVIDHVNIFARATPEHKLNIVRALRKRGDVVAMTGDGVNDAPALKLSDIGVSMGRIGTDVAKEASDMVLTDDDFSTILTAIEEGKGIFNNIQNFLTFQLSTSVAALSLVALSTAFKLPNPLNAMQILWINILMDGPPAQSLGVEPVDHEVMKKPPRKRTDKILTHDVMKRLLTTAACIIVGTVYIFVKEMAEDGKVTARDTTMTFTCFVFFDMFNALACRHNTKSIFEIGFFTNKMFNYAVGLSLLGQMCAIYIPFFQSIFKTEKLGISDILLLLLISSSVFIVDELRKLWTRKKNEEDSTYFSNV

SEQ ID NO: 155 - DNA, 2079 bp, Saccharomyces cerevisiae
atgaatggaaaagaggtttcaagtggctctggaagaacgcagagcaacaacaacaaaaaaaataacaacggaggcagtacaggaatctcgcatgcgtctggctcacctttaacggacggcaacggtggcaatagcaacggtaatagtagaagtagaagcagaagtagaaaatctagtggaactacaggtggtttgctaaaaaagccgccgctgcttgtgaacaatgaagcggtgcatgctagcgtacccgacgcgtcgcacacttcctgtaacaatggcacgcttgaagtgagcataaataaccctgagccacatgtggtagatgccgtggcacgccacttgataagaaacccgagtaacagcctacaattgcaaggcggagacattacaagagatctgtataagtggacaaacgaccatccttcatcaccatcgcagtatcagtacccaagtcaacctgcactttccacctcaataccttcacaagcgccctcattctcgaatcgtaaaaggtctatgagcttttctgccgcttctatagcatcttcctctcaccttaacaacaactcggaggcgaatgggaatcctctagcggcaataggcctggcgcccgcaccgatgacgcacgaagaaatcagggctcctggtggattcagaagatcttttataatacagaagcgcaggaaacataacgttgatgcgcccataccgaattttttcaccaggaactttattgaatttttgaccttgtatggccacttcgctggtgaagatttatcggaagaagaggaggaggaggaagaaactgaagaggagccagaggaggaagctttggaaacggaaagcacccagctagtttctcgtgaacacgggcgccatcctcacaaatcatctacggtaaaggcggtgctgctcttgttaaagtcatttgttgggacaggtgtgcttttcctaccaaaggctttccataacggtggttggggatttagcgccctttgtctactctcgtgtgccctcatttcttatggatgtttcgtatcattgattaccaccaaggacaaagtaggcgtagatgggtacggtgacatgggtcgtatactatatgggcccaaaatgaaatttgccattctttcgtctatcgccttgtcacaaatcgggttttctgctgcatacactgttttcactgcaactaatttgcaggtcttttctgaaaatttcttccatttgaaaccgggcagcatcagtctagccacctatatctttgcacaagtactcatctttgtcccactatctttgacaagaaacatagccaagttaagtgggaccgcgttaatagcagatctatttattctactgggattggtttatgtttacgtttactccatttattatattgctgttaatggtgtcgcatccgatacaatgcttatgttcaataaagcggactggtcgttgttcatcggtaccgccatattcacctttgaaggtataggcctacttatccccattcaggagtcaatgaaacacccgaagcatttccggccatcgttgtccgcggtgatgtgtatcgtggcagtgattttcatatcatgtggtctcttatgctatgccgcttttggatctgacgtgaaaactgttgttttattgaattttccgcaggacacttcctatactctcactgttcaattactgtatgcattagccattttgttatccacgccgttgcagctatttcccgcgatacgtattttggaaaactggacttttccctcaaatgcatctggtaaatacaacccgaaagtcaaatggttgaaaaactatttccgttgcgctattgtcgtcctgacatctatcctcgcttgggtaggcgccaacgatttggacaaatttgtatcactggtaggctccttcgcgtgtatcccattgatctacatatacccgccattgttgcactataaggcgtccatcttatctggaacctcgagagccaggcttcttttagatttaatcgtcatagtatttggagttgctgtcatggcctacacgtcatggcagacgattaaaatgtggagccagtaa

SEQ ID NO: 156 - protein, 692 aa, Saccharomyces cerevisiae
MNGKEVSSGSGRTQSNNNKKNNNGGSTGISHASGSPLTDGNGGNSNGNSRSRSRSRKSSGTTGGLLKKPPLLVNNEAVHASVPDASHTSCNNGTLEVSINNPEPHVVDAVARHLIRNPSNSLQLQGGDITRDLYKWTNDHPSSPSQYQYPSQPALSTSIPSQAPSFSNRKRSMSFSAASIASSSHLNNNSEANGNPLAAIGLAPAPMTHEEIRAPGGFRRSFIIQKRRKHNVDAPIPNFFTRNFIEFLTLYGHFAGEDLSEEEEEEEETEEEPEEEALETESTQLVSREHGRHPHKSSTVKAVLLLLKSFVGTGVLFLPKAFHNGGWGFSALCLLSCALISYGCFVSLITTKDKVGVDGYGDMGRILYGPKMKFAILSSIALSQIGFSAAYTVFTATNLQVFSENFFHLKPGSISLATYIFAQVLIFVPLSLTRNIAKLSGTALIADLFILLGLVYVYVYSIYYIAVNGVASDTMLMFNKADWSLFIGTAIFTFEGIGLLIPIQESMKHPKHFRPSLSAVMCIVAVIFISCGLLCYAAFGSDVKTVVLLNFPQDTSYTLTVQLLYALAILLSTPLQLFPAIRILENWTFPSNASGKYNPKVKWLKNYFRCAIVVLTSILAWVGANDLDKFVSLVGSFACIPLIYIYPPLLHYKASILSGTSRARLLLDLIVIVFGVAVMAYTSWQTIKMWSQ

SEQ ID NO: 157 - DNA, 1809 bp, Saccharomyces cerevisiae
atgagtaatacttcttcgtacgagaagaataatccagataatctgaaacacaatggtattaccatagattctgagtttctaactcaggagccaataaccattccctcaaatggctccgctgtttctattgacgaaacaggttcagggtccaaatggcaagactttaaagattctttcaaaagggtaaaacctattgaagttgatcctaatctttcagaagctgaaaaagtggctatcatcactgcccaaactccattgaagcaccacttgaagaatagacatttgcaaatgattgccatcggtggtgccatcggtactggtctgctggttgggtcaggtactgcactaagaacaggtggtcccgcttcgctactgattggatgggggtctacaggtaccatgatttacgctatggttatggctctgggtgagttggctgttatcttccctatttcgggtgggttcaccacgtacgctaccagatttattgatgagtcctttggttacgctaataatttcaattatatgttacaatggttggttgtgctaccattggaaattgtctctgcatctattactgtaaatttctggggtacagatccaaagtatagagatgggtttgttgcgttgttttggcttgcaattgttatcatcaatatgtttggtgtcaaaggttatggtgaagcagaattcgtcttttcatttatcaaggtcatcactgttgttgggttcatcatcttaggtatcattctaaactgtggtggtggtccaacaggtggttacattgggggcaagtactggcatgatcctggtgcctttgctggtgacactccaggtgctaaattcaaaggtgtttgttctgtcttcgtcaccgctgccttttcttttgccggttcagaattggttggtcttgctgccagtgaatccgtagagcctagaaagtccgttcctaaggctgctaaacaagttttctggagaatcaccctattttatattctgtcgctattaatgattggtcttttagtcccatacaacgataaaagtttgattggtgcctcctctgtggatgctgctgcttcacccttcgtcattgccattaagactcacggtatcaagggtttgccaagtgttgtcaacgtcgttatcttgattgccgtgttatctgtcggtaactctgccatttatgcatgttccagaacaatggttgccctagctgaacagagatttctgccagaaatcttttcctacgttgaccgtaagggtagaccattggtgggaattgctgtcacatctgcattcggtcttattgcgtttgttgccgcctccaaaaaggaaggtgaagttttcaactggttactagccttgtctgggttgtcatctctattcacatggggtggtatctgtatttgtcacattcgtttcagaaaggcattggccgcccaaggaagaggcttggatgaattgtctttcaagtctcctaccggtgtttggggttcctactgggggttatttatggttattattatgttcattgcccaattctacgttgctgtattccccgtgggagattctccaagtgcggaaggtttcttcgaagcttatctatccttcccacttgttatggttatgtacatcggacacaagatctataagaggaattggaagcttttcatcccagcagaaaagatggacattgatacgggtagaagagaagtcgatttagatttgttgaaacaagaaattgcagaagaaaaggcaattatggccacaaagccaagatggtatagaatctggaatttctggtgttaa

SEQ ID NO: 158 - protein, 602 aa, Saccharomyces cerevisiae
MSNTSSYEKNNPDNLKHNGITIDSEFLTQEPITIPSNGSAVSIDETGSGSKWQDFKDSFKRVKPIEVDPNLSEAEKVAIITAQTPLKHHLKNRHLQMIAIGGAIGTGLLVGSGTALRTGGPASLLIGWGSTGTMIYAMVMALGELAVIFPISGGFTTYATRFIDESFGYANNFNYMLQWLVVLPLEIVSASITVNFWGTDPKYRDGFVALFWLAIVIINMFGVKGYGEAEFVFSFIKVITVVGFIILGIILNCGGGPTGGYIGGKYWHDPGAFAGDTPGAKFKGVCSVFVTAAFSFAGSELVGLAASESVEPRKSVPKAAKQVFWRITLFYILSLLMIGLLVPYNDKSLIGASSVDAAASPFVIAIKTHGIKGLPSVVNVVILIAVLSVGNSAIYACSRTMVALAEQRFLPEIFSYVDRKGRPLVGIAVTSAFGLIAFVAASKKEGEVFNWLLALSGLSSLFTWGGICICHIRFRKALAAQGRGLDELSFKSPTGVWGSYWGLFMVIIMFIAQFYVAVFPVGDSPSAEGFFEAYLSFPLVMVMYIGHKIYKRNWKLFIPAEKMDIDTGRREVDLDLLKQEIAEEKAIMATKPRWYRIWNFWC

SEQ ID NO: 159 - DNA, 1728 bp, Saccharomyces cerevisiae
atggtgaacgttggtccttctcatgctgcagttgctgtggatgctagcgaagcccgcaaaagaaatatttcagaagaagtattcgaactgagggataagaaagattctacagtggtaattgagggtgaagccccggtaagaacttttaccagtagctctagtaaccatgaaagagaggatacgtatgtttctaaaaggcaggtaatgagagatatttttgctaaatacttgaagttcattggacctggattgatggttagtgtggcttacatcgatcccggtaattactctactgccgtcgatgcaggtgcctctaatcaattttccctactttgtatcattttgttatcaaactttattgccatatttttgcaatgtctgtgtatcaagttgggttccgttacgggactagatctaagtcgagcttgcagagagtatttaccacggtggctcaactggacattgtatttttttgcagaatgtgccgttatagccaccgatatagctgaagtgattggtacagcgattgccttgaatatcctgatcaaagtgccccttccagcgggcgtggccattactgttgtggatgtgtttttgattatgtttacatataaacctggtgcgtcatcaattaggttcattagaatatttgaatgttttgttgcagtattagttgttggcgtgtgcatttgtttcgcaatagaattggcttatatcccgaagagtacgtccgttaaacaagtgttcagaggatttgtgccatctgcccaaatgtttgaccacaatggtatttataccgctatttccatcttaggtgctactgttatgccacattcgttgtttttgggttccgctttagtgcagccaaggcttttagattatgacgttaaacacggtaattatactgtttctgaagaacaagataaagtgaaaaaatctaaatccactgaagagattatggaagaaaaatattttaattatagacccacgaacgctgctatcaaatattgcatgaaatattctatggtcgaattaagcataactctcttcaccctagcgcttttcgtcaattgtgccatcctagttgttgcgggctccactctatataactcaccagaagcagatggggcagatttgtttactattcatgaattattatcaagaaatctggcacccgcagcaggtacgattttcatgctcgcacttttattaagtggtcaatccgcaggtgtagtgtgtactatgtcgggtcaaattgtaagtgagggtcatattaattggaagttgcagccatggcaaagaagattggccactagatgtatttcgataatcccttgtttggtcatctctatctgtatcggtagagaagctttatcaaaggccttaaatgcttcccaagttgttttatccatagttctgccatttttggtagcacctttaattttcttcacatgtaaaaaatcaatcatgaaaaccgaaattaccgtcgaccatactgaagaagatagccataaccatcaaaataacaacgatagatctgcaggtagcgtaatcgagcaagatggttctagtggcatggagatagaaaatggaaaagatgtcaaaatcgtttatatggcaaacaattggattatcactgttattgctataattgtgtggcttttcttatctttactgaacgtttatgccattgttcaattaggcatgtctcatggtgatatcagttaa

SEQ ID NO: 160 - protein, 575 aa, Saccharomyces cerevisiae
MVNVGPSHAAVAVDASEARKRNISEEVFELRDKKDSTVVIEGEAPVRTFTSSSSNHEREDTYVSKRQVMRDIFAKYLKFIGPGLMVSVAYIDPGNYSTAVDAGASNQFSLLCIILLSNFIAIFLQCLCIKLGSVTGLDLSRACREYLPRWLNWTLYFFAECAVIATDIAEVIGTAIALNILIKVPLPAGVAITVVDVFLIMFTYKPGASSIRFIRIFECFVAVLVVGVCICFAIELAYIPKSTSVKQVFRGFVPSAQMFDHNGIYTAISILGATVMPHSLFLGSALVQPRLLDYDVKHGNYTVSEEQDKVKKSKSTEEIMEEKYFNYRPTNAAIKYCMKYSMVELSITLFTLALFVNCAILVVAGSTLYNSPEADGADLFTIHELLSRNLAPAAGTIFMLALLLSGQSAGVVCTMSGQIVSEGHINWKLQPWQRRLATRCISIIPCLVISICIGREALSKALNASQVVLSIVLPFLVAPLIFFTCKKSIMKTEITVDHTEEDSHNHQNNNDRSAGSVIEQDGSSGMEIENGKDVKIVYMANNWIITVIAIIVWLFLSLLNVYAIVQLGMSHGDIS

SEQ ID NO: 161 - DNA, 981 bp, Saccharomyces cerevisiae
atggcagaagtactgaccgtcctcgagcagccgaactcaattaaagattttctcaagcaggattcaaatattgcgtttctagctggtggagtagctggcgcggtttcccgaaccgttgtttcaccttttgagagagttaaaatactgctgcaagttcaaagttcaaccacttcttataaccgaggtatctttagctctatacggcaggtttaccatgaggagggaaccaaaggtttattcagaggaaatggtttgaactgcataagaatttttccctatagtgcagtccagtttgtagtatacgaagcttgtaagaaaaagttattccatgtaaatggcaataatggacaagaacaactaacgaacacccaaagactattcagtggtgcattgtgtggtggttgtagtgtggtggctacttacccgttggacttgatcaaaacaagactatcgattcagacagcaaatttgagcagtttaaaccgctcaaaggcaaaaagtatatcaaagcctccggggatctggcaattactaagcgaaacttacagactcgaaggcggtctcaggggattatataggggtgtatggccaacgagtcttggtgttgttccatatgtagcactaaactttgcagtttacgaacaattgagagaattcggtgtcaattcctccgatgctcagccttcctggaaaagtaacctctataaattaacaattggcgccataagtggaggggttgcgcaaacaatcacttatccctttgatctgctaagaagaagatttcaagttctcgcaatgggcggaaatgaactgggatttagatacacgagtgtctgggatgcgctcgtgacaatcggcagagcagaaggcgttagcggttactacaaaggcttagctgcaaacctttttaaagttgttccttcaactgcagtgagttggctagtttacgaagttgtatgtgattctgtaagaaattggtga

SEQ ID NO: 162 - protein, 326 aa, Saccharomyces cerevisiae
MAEVLTVLEQPNSIKDFLKQDSNIAFLAGGVAGAVSRTVVSPFERVKILLQVQSSTTSYNRGIFSSIRQVYHEEGTKGLFRGNGLNCIRIFPYSAVQFVVYEACKKKLFHVNGNNGQEQLTNTQRLFSGALCGGCSVVATYPLDLIKTRLSIQTANLSSLNRSKAKSISKPPGIWQLLSETYRLEGGLRGLYRGVWPTSLGVVPYVALNFAVYEQLREFGVNSSDAQPSWKSNLYKLTIGAISGGVAQTITYPFDLLRRRFQVLAMGGNELGFRYTSVWDALVTIGRAEGVSGYYKGLAANLFKVVPSTAVSWLVYEVVCDSVRNW

SEQ ID NO: 163 - DNA, 1761 bp, Saccharomyces cerevisiae
atgttttcacttagttcgctatctagcagcggtgggcattcagagcagaaggaaagagagagaataagttattttgatattagaataaactccccgtacaaggacataattttgatccaagggtcaccgttggaactgtcgtctatacctttatcaggaaacttagtgatttcagtgaaaaatgagatcgtagtgaagaaaatttcgctgagattggtaggaagattcaaattggagtttttgcaagttggccgatataagaagaatagcagtagtttggcaagtctagttaaggaaaagcgtaagattttcgaatgctattgggacaacttattggtttcttcaaaaggggatgttttagtcggtggggaaaatgcggaaaatcaacataacagtagtagcggtcgcagtacaagcaaccaagatatggacaccagcggcaacgcaatatttctaagcaagagatcactttcgagccctgttttcaacaaaataattcgaagaaagacccattcttcccacagaaaaatactagagctaccagaaaatggtgttacaggaacccctttcgagggtttaagagaaaacgcccgtagtagaagcagtagtagtaacaccctcaataacaatagccatagttatagtaacagagacgggtctggaagttcgtacttattcctaatgaaaagaggcaactacgaactacccttcaatacaatgctccccccagaagtgtgcgaaacaatcgagggactacaaagtggtagcatactgtattcctttgaagccattatagatggacgtcagttatgggatactgatctgagcgttcatacttctcctcacggtccaatcggtagcacaagtacgagcggcaatggtatgagaacgaagaataaaattatcatcaaaaagttcaagtatctcagaatccttcgtacattatcgatggacaatcttgccatgcaagaagaaattagcgtgggtaatacttggcgtgacaagttgcaatacgaaacgtccatcccgagtagggctgttcctattggtagcacaacccccgtgaagattaagattttccccttcgaaaagaacattcgtttggataggatagaaatggcgctaatccaatattacgcaatgaaggacagcagcgcacaaatttatgatgatgaaatagccgtcatgaaaattactcatctagcggacttcggcccgctgacggacaaacttgacgtcgattgtccctttacaattccagataacctcaaacaaataactcaagactgctgtctgcaagacaacctaatccgtgtcatgcacaaattgcaggtacgtattcttttacaacgtcaagtggatggcgaatacaagaacctggagatcaaggcgcaattacctatgttattatttatttcgccgcatctgcctatgaaaggccgtctagtgttgtttgataaacacgatggcaagatccacttccgccctggcgaattagtacccctttttttaaccacttaccccgcgcagggtctgactccaggcgttgaactgaactccactacaacggcgcacctcgcgctgccacaaccgccaccgaattatcacgagagcaccaacgatcatctcatgccggcgctacagccgctcggcgccgattcggtggtactgacagtgccgtcatacgagcaggcgcaggcgcaggcatcggcatcgtcttacgtgacagggtccgtacccgcttactgcgacgatgactga

SEQ ID NO: 164 - protein, 586 aa, Saccharomyces cerevisiae
MFSLSSLSSSGGHSEQKERERISYFDIRINSPYKDIILIQGSPLELSSIPLSGNLVISVKNEIVVKKISLRLVGRFKLEFLQVGRYKKNSSSLASLVKEKRKIFECYWDNLLVSSKGDVLVGGENAENQHNSSSGRSTSNQDMDTSGNAIFLSKRSLSSPVFNKIIRRKTHSSHRKILELPENGVTGTPFEGLRENARSRSSSSNTLNNNSHSYSNRDGSGSSYLFLMKRGNYELPFNTMLPPEVCETIEGLQSGSILYSFEAIIDGRQLWDTDLSVHTSPHGPIGSTSTSGNGMRTKNKIIIKKFKYLRILRTLSMDNLAMQEEISVGNTWRDKLQYETSIPSRAVPIGSTTPVKIKIFPFEKNIRLDRIEMALIQYYAMKDSSAQIYDDEIAVMKITHLADFGPLTDKLDVDCPFTIPDNLKQITQDCCLQDNLIRVMHKLQVRILLQRQVDGEYKNLEIKAQLPMLLFISPHLPMKGRLVLFDKHDGKIHFRPGELVPLFLTTYPAQGLTPGVELNSTTTAHLALPQPPPNYHESTNDHLMPALQPLGADSVVLTVPSYEQAQAQASASSYVTGSVPAYCDDD

SEQ ID NO: 165 - DNA, 1629 bp, Saccharomyces cerevisiae
atgtcgttactgagactgtggaacaaagaatcaagggcaccatcaaaaataaagagtcatggtattgttggcagttacggcaacagcatgctggcccataacaacgtgaagcaatttcgtatagacatagacgaaccgcatagagtatggaaaccgaatgaaagcataaccggagaagcggtcattgacataaagagagacataactaacgtagcgatcaaattatcgctagtatgtgaggttcgcgtgaaaacggggaacagtccaacctccaagaataagagaattgagaaaaccttagagaagtcgacgtttctttatggacaggactacgtaaagacagctttttcggctaaggaaaagaaaccgcatgttgacaaaaccaccattctcaatggtttaagcaagggggaacacaggtttccctttaggatacgaataccacgaggcagaggaatgttgagctctataaagttcgaaaggggctcgataacatacttcctctcttgcactttagaatccctcaacaacatcaacggattaaaaaaaccggaagcaagatgcgaacgtgagtttgcagtcatagttccgctggacgtctcgaggctgcccaagccgaaaactaagacagtggttttacaatcagcatctatggtccaaaacaaaaagaacaaatctacagaggacgaatcctcatcgtatacacaattaactcaaaagtctactacttctaattcttctagcagttcagtaaactccaagacgtcccccttaccaaataaaacggtgactatatccgtagacataccgcaggctggattcatgattggtgaaattatccctatagacgttaagattgaccactataagcctttctatgcccctgcgggtctcaccaccactttggtgaggatatgtagggtgggcggtgcaggcaaagatgatcctatggagactttcagaaaagatatatgtcagagtatctctcctatatatattaaccctgaaacgttgcagtttcaatctagagtttatctgaaagtgccccttgatgcattttcgacccttactactgtgggaaaatttttctccttccaatactatatcgaggttatggttaacttatcaaaaaaaaacgtggtttacacagaatctaatagaataataggaactcctattggagaacaaaatggcttgggcgtagagaataatatcaaccgtatccaaaggaaaatgctacgtatggtcaatccagaaacgttggagaacgattctgagggttatgaatccagtatatttttcaaagatatggtaaatgtggaaaagctaaagagactgaggaatgtaactggtatgtccatagaaaccgtcataggaacgacgagatccgaacagcagcaatctgatgcaagcatcccatcccaatcctcaatcacggctcctcaaaattctccatcgaatttaagagattggttggccccattaaatgcatatgatagtgacgatgttccagttccaaagtattcgccaaatgataaagtcagtgtaccgtcggaagacaaacaagaacttgaacaaaaaagactacaacagttagaaagcgatcctcccccttgtgatgactattaa

SEQ ID NO: 166 - protein, 542 aa, Saccharomyces cerevisiae
MSLLRLWNKESRAPSKIKSHGIVGSYGNSMLAHNNVKQFRIDIDEPHRVWKPNESITGEAVIDIKRDITNVAIKLSLVCEVRVKTGNSPTSKNKRIEKTLEKSTFLYGQDYVKTAFSAKEKKPHVDKTTILNGLSKGEHRFPFRIRIPRGRGMLSSIKFERGSITYFLSCTLESLNNINGLKKPEARCEREFAVIVPLDVSRLPKPKTKTVVLQSASMVQNKKNKSTEDESSSYTQLTQKSTTSNSSSSSVNSKTSPLPNKTVTISVDIPQAGFMIGEIIPIDVKIDHYKPFYAPAGLTTTLVRICRVGGAGKDDPMETFRKDICQSISPIYINPETLQFQSRVYLKVPLDAFSTLTTVGKFFSFQYYIEVMVNLSKKNVVYTESNRIIGTPIGEQNGLGVENNINRIQRKMLRMVNPETLENDSEGYESSIFFKDMVNVEKLKRLRNVTGMSIETVIGTTRSEQQQSDASIPSQSSITAPQNSPSNLRDWLAPLNAYDSDDVPVPKYSPNDKVSVPSEDKQELEQKRLQQLESDPPPCDDY

SEQ ID NO: 167 - DNA, 966 bp, Saccharomyces cerevisiae
atgccagagcaagaactacttatagggcaagaaatgaatacacttcatgcaggttcatctactgatggcataaatgtcggaaacgcaggacgaactagagacacacaaactggcgtagaaggggaaacggaaatagggtctgacgaggaagatagcatagaggacgagggaagcagcagtggaggaaatagtacgacagaaagactagtaccacaccagctgagggaacaagcagccagacatataggaaaaataggaagacattttaatattcttgatagactttttaagaaacgtacacaacagtcttcggatatacaacaaggtgccatgtttgatggtgtctttagcaatttaagcgcaaaaccagataccacagagactgaaggtaataacgaacaagacataccacctacatacgacgaagctgctgctgatatggccccctcgtattatggaatggatttgaacaattcagatatctactacgacgaaatatgcattgaggggcttcctgtaggaaatatagcaaatttattatggaatatcatcgtaagcacgagttttcagttcattggatttttaataacctacattttacacacatctcacgcagcaaagcaaggttcaaggtttggattagggttaacgttcattggatatggttattcaatgattcccaatgatgttacttcaaaagtcggcaaaaataaaagcttaaatagaatggaattagaggatccaaatgaattcgatgatgttcgtctaaattcacaatcaacgacacaagataaatttgaatcacatttgaatcacggtctggatgaagaaaaacaaaacataccatggttggctgtttttgtggcatttcttgggctatttatcaccctgaagagtatatacgactacattcaagtcaaaaaattggaaaagaaatacctcaaccaaagtcaaaatcaagcataa

SEQ ID NO: 168 - protein, 321 aa, Saccharomyces cerevisiae
MPEQELLIGQEMNTLHAGSSTDGINVGNAGRTRDTQTGVEGETEIGSDEEDSIEDEGSSSGGNSTTERLVPHQLREQAARHIGKIGRHFNILDRLFKKRTQQSSDIQQGAMFDGVFSNLSAKPDTTETEGNNEQDIPPTYDEAAADMAPSYYGMDLNNSDIYYDEICIEGLPVGNIANLLWNIIVSTSFQFIGFLITYILHTSHAAKQGSRFGLGLTFIGYGYSMIPNDVTSKVGKNKSLNRMELEDPNEFDDVRLNSQSTTQDKFESHLNHGLDEEKQNIPWLAVFVAFLGLFITLKSIYDYIQVKKLEKKYLNQSQNQA

SEQ ID NO: 169 - DNA, 1653 bp, Saccharomyces cerevisiae
atgtcattcaagtttctgatagaatcgctgcttctcggttcgataagcggacaaatacggtgtggtagatcttcggtgatcccccgtggcgatgtatcttatgggggagacgatactgacgaacttaacatggatataatgttgtttgcgtttggaaccttaatcgtggtctacatcgtcatctgtatcgtttatttttttacaaaacagatagctacgcggcttataactgcatattataatgagcatggccctggccaaagaatatctttattcagcgattatgacgaaaataatgcacacgttcatagcagaagattaatggaaaacatgagtttaaggtggcccaacaatcttgacgatgctgatgaagtaagagataagctggcacagttgtcacctgaagagcagttttattataagcaaggtgaggagtatatcaagcagaacccaccatttctgcttaaccagggacttttacaacagtccgaagatagcaatccagacaccacccgtgaagaccctattatgaacgagcaaacaaggcaatatattcaagaagagggggcttatgcatgggagtttagcccaaatcctgatatgccaaaccatactgtcatagtggaaaataaaacagaggtttcttttctaaattataattatgatgcttctatatccacaaatctacccattccgtgtataaataaagtatattattgtgaattcaagatatttgaaacggatggcccactaaacagtgatgaaaatgtatcgaaaggtgtcatctcatttggtctttccacacagccttatccatatttcaggttaccgggaagacaccaccattcgatagcatacgattctaacggcgccagaagatttaatgactccttcaaactaaatgagcaattaagaacgttatttccacagtgtgaaaagggagacattgttggcattggctataggtcacgtagtggaacagtatttttcaccaggaacggaaaaaaactaaatgaaaaatctgttggtggtcatatccgcggctggaaattccaatacctatacccgatcattggctccaacgtaccttgtcaaattcatgtgaatttcggcacttatggctttgtttatatagaagcaaacgttaaaaaatggggatacgcaaagtcaaacggcattaaattacctcctccttcttacgaagactacggtaaagataccctattagaaagcggtggtgaagacaatgatttcgacgaagatttttcagacggtgatagcgacaatattgcggctggtagtactacaaatctcaatgatgatataattataagaaacggtgaaatattaccgccaccacctggatttgaattcactatgtcccctcccactggaaagaagatcatcaatgaggaaattaatctagattccttacctatgctaccaccaagttactcggacgatgaacatcattcgaaaaatgataaatcagcaataagcggacgaattattggaacgagcagaaatttaattactgatgaagcatctttcgatagtgttgataatgataacgaagatgaaaatgatcacgagagagatcccgaacaattttcagaatttgatgattacgaaagcaggatgcatggcatataa

SEQ ID NO: 170 - protein, 550 aa, Saccharomyces cerevisiae
MSFKFLIESLLLGSISGQIRCGRSSVIPRGDVSYGGDDTDELNMDIMLFAFGTLIVVYIVICIVYFFTKQIATRLITAYYNEHGPGQRISLFSDYDENNAHVHSRRLMENMSLRWPNNLDDADEVRDKLAQLSPEEQFYYKQGEEYIKQNPPFLLNQGLLQQSEDSNPDTTREDPIMNEQTRQYIQEEGAYAWEFSPNPDMPNHTVIVENKTEVSFLNYNYDASISTNLPIPCINKVYYCEFKIFETDGPLNSDENVSKGVISFGLSTQPYPYFRLPGRHHHSIAYDSNGARRFNDSFKLNEQLRTLFPQCEKGDIVGIGYRSRSGTVFFTRNGKKLNEKSVGGHIRGWKFQYLYPIIGSNVPCQIHVNFGTYGFVYIEANVKKWGYAKSNGIKLPPPSYEDYGKDTLLESGGEDNDFDEDFSDGDSDNIAAGSTTNLNDDIIIRNGEILPPPPGFEFTMSPPTGKKIINEEINLDSLPMLPPSYSDDEHHSKNDKSAISGRIIGTSRNLITDEASFDSVDNDNEDENDHERDPEQFSEFDDYESRMHGI

SEQ ID NO: 171 - DNA, 1740 bp, Saccharomyces cerevisiae
atgtatgtcacttttaatgaggctttggatagttcttttggtaatctagagagtccgaatcatgacttcaaagtaggtgaccctaacatggtaccaactccccctatggattcagattctgcagcaattagtttggctttcttaataagtctttctattacgtttgcaatattaatgctcatcttggtagtaatagcggcatatgtcaccttttgtggtgatgatgaatcagaatacgacgaagagaacgccttaggtacacgaacttcaggaactctgcactctttgtttggtaaaaaacatagtggcatcttgttggattcgagttttgcatcccctggcgggtttgatgatgagatcgttcttcaggaaagagaacttgaagaattaccaaagatgtcagcgtacgaggttgagttgtatataagagcgaaagagtttcaaatgatgagcccgccaatggtgaaggactttggcacgtatttggacagtgacgaccagcagtttattaaggatcgtggcattcaaagctattttttgctaccaagcattaatgataatatagacgaatatggaaactttctacccagttttattgtccaggataaactagatattcaattttcaaagttcaataagagctcatccactgtaatgaactatcccctacctcacaataggaaggacgcagtgtatttcgaagttaaaattttcagacatattcaaaagtccaatagtatattcagtataggtttgactactgtaccatatccttatttcagggtaccgggcatggccaaatactccattgcatacgaatccacaggtaaactgaggataaataaccccttcactgccagcacattattaccaaaattggaagaaggtgacacggtaggattcggttacagatataaaacaggtacaatcttcattacacataatgggaaaaaattaatggatgtaacacaaaatattggcattgatcttttcattggaattggcgcgtttaatgccgcatatacaagaacatatacgagggatggtctattggaagacccggataatgttagcttccgtgaagctctctctgaaggcaaagatattgaagtcgccaaagatcttcaaagagttcacgatccacatgatgaaagtgatgaaatgacgtcagatgaggttgaattacatgttaatttgggccaagttgggttcgtctttatagaagccaatgtgaaaaaatatgcgtttgggagtgtttatggccaaattggaattcctcctgcgtataatggaaccgagatcaagaaggatactattttacagaaaggagaagaattgccaccaagatatgctgacactgataatttctttggtagtatgaaggtaaaagaagggtcatcctctaggataacggcgcaaactagtaagcccctgtggtctgttgggacgtatgaaagaatctcttctaactttgacagagaaaataatgtttaccacgacagtcttgaaaccgacgataacaacaccgataacaatgttaataacaacgatgagaacgctggttgcaatgaaaattcgccattattggaagatgatggcaataaaagaccggaaaattcaaataccccccgtgaagtatcagatggagctatcaataagaaccctagaaataaatctactaaaaaacgtcaaagaaacagaggcaaatcttctaaaaagaagaacagatcgagaaaataa

SEQ ID NO: 172 - protein, 579 aa, Saccharomyces cerevisiae
MYVTFNEALDSSFGNLESPNHDFKVGDPNMVPTPPMDSDSAAISLAFLISLSITFAILMLILVVIAAYVTFCGDDESEYDEENALGTRTSGTLHSLFGKKHSGILLDSSFASPGGFDDEIVLQERELEELPKMSAYEVELYIRAKEFQMMSPPMVKDFGTYLDSDDQQFIKDRGIQSYFLLPSINDNIDEYGNFLPSFIVQDKLDIQFSKFNKSSSTVMNYPLPHNRKDAVYFEVKIFRHIQKSNSIFSIGLTTVPYPYFRVPGMAKYSIAYESTGKLRINNPFTASTLLPKLEEGDTVGFGYRYKTGTIFITHNGKKLMDVTQNIGIDLFIGIGAFNAAYTRTYTRDGLLEDPDNVSFREALSEGKDIEVAKDLQRVHDPHDESDEMTSDEVELHVNLGQVGFVFIEANVKKYAFGSVYGQIGIPPAYNGTEIKKDTILQKGEELPPRYADTDNFFGSMKVKEGSSSRITAQTSKPLWSVGTYERISSNFDRENNVYHDSLETDDNNTDNNVNNNDENAGCNENSPLLEDDGNKRPENSNTPREVSDGAINKNPRNKSTKKRQRNRGKSSKKKNRSRK

SEQ ID NO: 173 - DNA, 2352 bp, Saccharomyces cerevisiae
atggtgaatactaggggctacactactcttccgaatgttgaagaaccagcaaataactcacaagatgagctaaactcgcaggactttgagcaagctataggaatgccatcagaacccccggtatatgtggaagagatggggatggaagaaccgcaggctccggaagcctttagtgagaaagtccagcgatttcgtatgtgttttgaaaataacgtggtgattccagtaaagaaaaatgtagtggatccgctagcacaaatgatttccctggcctctgagaaattcgatttgttcttaagtaaaataggtaatgttatggtaatgaggagaatattttacatcatgatgatgtctatcattgcagcgttgattattgcgagtgataggttaccgaatggaaaagctcgaggttcaaatggatcattctcggaccatgatctccttttacagtatgctcggaaatcgatagacctttcaaagatagaaagagatttagagtatattagtagtatgccccacatgtcaggaacaagtggtgatgccgctattagacattatattaaagagtcgttcgacaaaaatggtataaggctagctggggaagaggagttcatggcgtattcgaattacccaggaaatgtctcacttcgtgtatattcaaaggatgatacagaagggtttgatattcccttaaatgaggagaactttaacccaatgagccataatggtcaattgaacaacataccggtgatttatgctaataaagcatcgttggacgatatggcttctatgcaagatcaagggcttttaaacggtgactttattttactagtgcattacggagattatgttttccaacaaatgttgactgctcaagaatatggtgcgaaagcaattatctttatttctgagccttatcaagacaacaaagacgtgatacaaatgaagtcagttgcgttgccgcagtatggtactggtgatgcacttacgcctgaatgggaaggatcaataagagatcctatcgatgctacggaagccaagtgcctacccaaaattccatccataccgatatctgccaatcaaggagataaaatactagctatattatcagacactggcgtaaagttttctaataatttattcagtgggtcgcttaacgattgtcgacttgacctactagtgcaaacagcaattagggaacgccacccggttcacgatatagttggtaaaattgaaggatcggaacaagcgggcagggcaattgttattgctgcaccgaggaactctgctagttatggcactatgtatccttcttttggaaccgtcgttttgctgtctctgatccaattatatcaagaaatggtttacaaatttgactggaagcctctaagaaatatatatttcatttcctttgggggctctgaatttaatgaagcgggagccacggagctgatggaaaagagaacagaggcattgaagagtgaaatatacaccattatcgacgtcggccaaatcggtatatgggatgatagtaacaatttagagatacaatgtcatccgctactagtagatctttttcaaaaaaacatgacaagccgtaaatttaacgttaaagtggataatgttcaccagttcggcgactggacgccgtatctagcgcaagggattccagttgcgatcatttcatctccaggagtcatgaatagagaacatccgatctacacagtagaagacaaattcgatttcatcaaagataaactaagagacaaaaagaagggagaggtactttctgagataatgctatatcttgtcgaaaaatcactcgagctcattgacgatccattcatcccattcagcatatcgaactacgtagatttcctttcaactacgttaaaagacctccaaaaagaatgtcctgatacggtaaactttgacgaagtctttttgggcacaacattgtgggaaaacactaaactgcagttcgaaaaatggaaaagcgaatggacagagcttatgtatggagccggtacatatatagaacccactatcattgccattaatcgttggtcatggaactacctactttccctaataggcgttacccaatgtttggaggaagggttaatggatagaaccttttacaagaacgttatcttcgggccaaaactctgggtcgacaaaggtgacccacttcgttcatggacgttccctgaaatcagggacactattgcaatcaaggactggagctctgtgcaggttcaagctaacacactcggcacaattttacaaaatacagcacgctattttcttgagaataaaaaccttcatggaataaacacgaacgaattttag

SEQ ID NO: 174 - protein, 783 aa, Saccharomyces cerevisiae
MVNTRGYTTLPNVEEPANNSQDELNSQDFEQAIGMPSEPPVYVEEMGMEEPQAPEAFSEKVQRFRMCFENNVVIPVKKNVVDPLAQMISLASEKFDLFLSKIGNVMVMRRIFYIMMMSIIAALIIASDRLPNGKARGSNGSFSDHDLLLQYARKSIDLSKIERDLEYISSMPHMSGTSGDAAIRHYIKESFDKNGIRLAGEEEFMAYSNYPGNVSLRVYSKDDTEGFDIPLNEENFNPMSHNGQLNNIPVIYANKASLDDMASMQDQGLLNGDFILLVHYGDYVFQQMLTAQEYGAKAIIFISEPYQDNKDVIQMKSVALPQYGTGDALTPEWEGSIRDPIDATEAKCLPKIPSIPISANQGDKILAILSDTGVKFSNNLFSGSLNDCRLDLLVQTAIRERHPVHDIVGKIEGSEQAGRAIVIAAPRNSASYGTMYPSFGTVVLLSLIQLYQEMVYKFDWKPLRNIYFISFGGSEFNEAGATELMEKRTEALKSEIYTIIDVGQIGIWDDSNNLEIQCHPLLVDLFQKNMTSRKFNVKVDNVHQFGDWTPYLAQGIPVAIISSPGVMNREHPIYTVEDKFDFIKDKLRDKKKGEVLSEIMLYLVEKSLELIDDPFIPFSISNYVDFLSTTLKDLQKECPDTVNFDEVFLGTTLWENTKLQFEKWKSEWTELMYGAGTYIEPTIIAINRWSWNYLLSLIGVTQCLEEGLMDRTFYKNVIFGPKLWVDKGDPLRSWTFPEIRDTIAIKDWSSVQVQANTLGTILQNTARYFLENKNLHGINTNEF

SEQ ID NO: 175 - DNA, 2430 bp, Saccharomyces cerevisiae
atgaggagcagttatcaaccagtgtcaactacaaactttgaacatgaaaatgctatacctactgcgtcgtcgtcccataatctgttgatgagccagcgttttgatgattctcctcctagttctaacgacaacagtatagaaactaatataacgcctccacctgaaccaccttcttatgaatttgatatagaggaccctcacgatgatcttcacaaaagaacacatctacagagggtttcaattgggtttcaggaaaaaattttggaacccttaatggaaaacatcattcatccactcttacaaatatcaaaattcgttccagacaaagctgactattacttaagtaaaatcggaaatccctttatacttcgaaggttcttttacatcattttcatgtcatttattgcatattatgtcttgtcaagtggctacttattcaacgaaaaggcatcaggatctaaagggatgttttctcaacacgatatactttttgaatatgccaaaaaatccgtggatttggcaaagtttgagagagatttggaatatattagtagcatgcctcatggatccggaacgaagggtgatgcagctatttatcgatacattcaggaatcttttgacaacaatgggttgaaattggttaaagaaatgggatactcagtttattctaattatccaggcaatgtatcaatttcatattatgataacaagaatgaaaagcatgatctagaactttctaaagaaaatttcaatccgttgagttctaacgggaaattatccaaagtgagcttgatttatggaggcaaaggtacaacatacgatttacaacatttaaaagattcgaaaacgatagaagatgggaaggactatgtgcttttactgcaatatgataaattagtgagtcagcaagtactaattgctgagaaattcggagctaaagctgtaatcttcatatctgagccatatggtgagaatatagacgttgttcaatctaagcctgtaggattgccccaatattcgactggtgatgcatcaggattgaattgggatggttctcctgtagaagaaaaggatcataaattttggcgtcaaactcatattccaactatcccaatctccacgagacaaggaaaagagctactatcgcgtttatcttcaggaggagtaacggttgatgatggtaatagtgatcgtagtaacagtgggaaaatgggagacgtattgatcgatgtagatctgcaaactaatgttagggaaaagcattttattcctaatattgttggtaaaattgaagggagagaacaatcagacaaagctataataattgctgcatcgagaaattccatcaattttggaactacttatcccaattttggtacagctgcattattatctatagttcaattattccaagaggtgaaatataagtttggttggaaacctttgagaaatatctatttcatctcattcggtggtaccgaatttaattatgctggatcttcggagctggttgagcaaaggctaacgccattaaaagacgaaatttattctttgattgatattagtcaactgggtataccctttgccgaaaaatatgagaacggtaaaactagaggagaattaagcattgagacacatcccttattgaagaagtttttcaatagaaacgcgcatggaaactttgatatatctgtggataatgtacagcactatggtgactggactccatttctggcaaatggaattcctgtatctgtaatatcttctgattctacgagaaaccgtgacaccccaactgaaacatctgaggataaatttgaacgtgttgagaagattctggaagacgaacagaaccaacaatctgtcaaggatttgctagtatatcttttacatattagtatggaattgattgatgacccgctacttcattttgacataataagctatgttgaagatatcgatgaaagattgcaaaggttagagcaagcataccctgaaaaactaaacttcacatcaataatcaaaggtttgttattttggaagaaaatcggtagcgaatgggcgtcatggactcaaggttgggagaacatagtatggtcgcatggggatggtatagagccctccttactttcaattaataggtggacatggaataaaaaattgactaatattggtagaagaacatgctctccggcgggtctacctaatagatcattttataagaacgttttgttcggaccaacattgatacaggaggataaatctaaaaatggtggaaatgtagatttctggacatttccaggagtgatggatgcgatttacgatgatgactggaagagggctcaagaacaaattgaccttattggcaaagtactccatcagtctgctgcattgtttgtcgaagagactaatgacatcgggtataaataa

SEQ ID NO: 176 - protein, 809 aa, Saccharomyces cerevisiae
MRSSYQPVSTTNFEHENAIPTASSSHNLLMSQRFDDSPPSSNDNSIETNITPPPEPPSYEFDIEDPHDDLHKRTHLQRVSIGFQEKILEPLMENIIHPLLQISKFVPDKADYYLSKIGNPFILRRFFYIIFMSFIAYYVLSSGYLFNEKASGSKGMFSQHDILFEYAKKSVDLAKFERDLEYISSMPHGSGTKGDAAIYRYIQESFDNNGLKLVKEMGYSVYSNYPGNVSISYYDNKNEKHDLELSKENFNPLSSNGKLSKVSLIYGGKGTTYDLQHLKDSKTIEDGKDYVLLLQYDKLVSQQVLIAEKFGAKAVIFISEPYGENIDVVQSKPVGLPQYSTGDASGLNWDGSPVEEKDHKFWRQTHIPTIPISTRQGKELLSRLSSGGVTVDDGNSDRSNSGKMGDVLIDVDLQTNVREKHFIPNIVGKIEGREQSDKAIIIAASRNSINFGTTYPNFGTAALLSIVQLFQEVKYKFGWKPLRNIYFISFGGTEFNYAGSSELVEQRLTPLKDEIYSLIDISQLGIPFAEKYENGKTRGELSIETHPLLKKFFNRNAHGNFDISVDNVQHYGDWTPFLANGIPVSVISSDSTRNRDTPTETSEDKFERVEKILEDEQNQQSVKDLLVYLLHISMELIDDPLLHFDIISYVEDIDERLQRLEQAYPEKLNFTSIIKGLLFWKKIGSEWASWTQGWENIVWSHGDGIEPSLLSINRWTWNKKLTNIGRRTCSPAGLPNRSFYKNVLFGPTLIQEDKSKNGGNVDFWTFPGVMDAIYDDDWKRAQEQIDLIGKVLHQSAALFVEETNDIGYK

SEQ ID NO: 177 - DNA, 2799 bp, Saccharomyces cerevisiae
atgacctctttatatgcacctggggcggaggatattcggcaaaggttacgtccttttgggtttttctttgagaaatcactaaaggatttgattaagggtattaggtctcacaacgaaacaccagaaaaactggatcaattctttaaacaagtattaagtgaatgccgggaagaagtgaactctccagatctaaattctaagaccaatgccgttcttaaattgacctatttagagatgtacggttttgacatggcttggtgcaactttcatatcttagaggttatgagcagtaataaacttcaacaaaaacgtgtggggtatttggctgcatcacaatctttttacaaagattctgacattttgatgcttgcaactaacttgttgaaaaaagacttaaagtatgacggaaacaatgatgttgttaaagttggcattgctttaagtggtctttccactataattacaccctcattagcaagagatatagctgatgatttgttcactatgctaaacagcacaagaccgtacataagaaagaaggccattaccgcactatttaaagtttttctgcaatatccagaggctttgagagataattttgataagtttgtttcaaagctagacgatgatgatatatctgtggtttctgccgctgtcagtgttatttgcgagctatcaaaaaaaaacccccaaccattcatccagctttcacctttattatacgagatattagttaccattgacaataactggataatcattagattattgaagttattcaccaacttatcacaagtggaaccgaaattgagagccaagttattgccgaaaattttagaactgatggagagtactgttgcaacttctgtgatctatgaatctgtcaactgtattgtcaaggggaatatgctagaagaagatgattttgaaacagcaatggcatgcctggaaagattgcacacattttgtgattctcaggatccaaatttgagatatattagctgcatattgttttacaagatcggcaaaatcaatactgattttatttctcggttcgaccaactgattatacgcttactctccgatgtcgacgtttctataagatcaaaagcaattgaattggttgaaggtattgttgatgaggataacttaaaggcaattgtccaaacattgatgaagcaatttgtagatgaagatgtggttatcctacaaactggaagcatcgtatacgaaaaatcaaagagaattcccataataattccagaaaattacaagataaaaatggtgaacgtcattatatcgatttgttcagctgacaactattccagtgttaacgactttgaatggtacaatgcagtaataatggacttggcgatgctctgtcaagacatatctgataaaagccttggatcaaaaattggtgaacagtttaggaatttgatgataaaagttccttcaatgagagaagtaaccattgctaatattataaagcttatttcaaatgacaatattaacaaacagttgcctaccgtattgagagaatgcatttggtgtctcggagaattttctaccctagttgaaaatggtaacgacttaataaaaatcatgactgagaatatcagttattattctcatagtgtacaagaagttttaattttagcacttgttaaagtatttagtaattggtgtaataactttcaggaggataaacgctttgaaattaaaatggtgttaaaagagctaattgaattttttgaaaatttatcttattcgagtacattcgaagtccaggaaagaagcgtagaagttttagaatttttaagactaagtttggaggctttagaggaggatacggaaggtctaccaatgctactgagcgaagtcctgcctagtttttttaacgcctatgaactcgcaccaattgcgcgtgggactcaattgaagttagcagtagatgagaatcttgatctagaaactccatttttgacaaaggaggcagctgatgaactcttagatgaacaaaaaagtgacgccatcagtgatttaatgtctgatatctcaatggacgagcaagttgaactaaaattcgttgatgattctgatacttcgtatgaagaaaaggaaaaattggatgattttgaaaatccatttgagattgagagagaaaaggaacggatgtcaaatccttattatctaggtgaagaagacgaagaaagaactaagaactctaaagatttgttggacttgaatgaggaggaaagtagtgataaaaagccagaaactattagattaaatagaaccgataattcgttgaattctctaagtttatctacaactgaaatcagcagaaagaagaagaagggaaagaagaaaaatagggttcaagtcttatccgatgaacctgttatcgaagccgctcccaaaaggaaagatgcattccagaaaccccatgataatcattcaactcaaaatcctttgaaaaaggacaagattaatctgagaatgcactctcaacttgaaaattttgatttttccaattttgggcaatcgagtaacgcaggaagaggatcgcaggaagagggcaaccttagaaaggaagacgagttagaattaagtcgtttagaggccaatcttattgtaaaagatgaaaaggataatttaagtgatactgaagaagttatagttataaaaaagaagaagaaagggaaaaagtcaaagtcaaaaaacaaactaaaaacgaaagcaaaaaattctccagaaccaaatgaatttcttcgagaccaaagcactgacatttaa

SEQ ID NO: 178 - protein, 932 aa, Saccharomyces cerevisiae
MTSLYAPGAEDIRQRLRPFGFFFEKSLKDLIKGIRSHNETPEKLDQFFKQVLSECREEVNSPDLNSKTNAVLKLTYLEMYGFDMAWCNFHILEVMSSNKLQQKRVGYLAASQSFYKDSDILMLATNLLKKDLKYDGNNDVVKVGIALSGLSTIITPSLARDIADDLFTMLNSTRPYIRKKAITALFKVFLQYPEALRDNFDKFVSKLDDDDISVVSAAVSVICELSKKNPQPFIQLSPLLYEILVTIDNNWIIIRLLKLFTNLSQVEPKLRAKLLPKILELMESTVATSVIYESVNCIVKGNMLEEDDFETAMACLERLHTFCDSQDPNLRYISCILFYKIGKINTDFISRFDQLIIRLLSDVDVSIRSKAIELVEGIVDEDNLKAIVQTLMKQFVDEDVVILQTGSIVYEKSKRIPIIIPENYKIKMVNVIISICSADNYSSVNDFEWYNAVIMDLAMLCQDISDKSLGSKIGEQFRNLMIKVPSMREVTIANIIKLISNDNINKQLPTVLRECIWCLGEFSTLVENGNDLIKIMTENISYYSHSVQEVLILALVKVFSNWCNNFQEDKRFEIKMVLKELIEFFENLSYSSTFEVQERSVEVLEFLRLSLEALEEDTEGLPMLLSEVLPSFFNAYELAPIARGTQLKLAVDENLDLETPFLTKEAADELLDEQKSDAISDLMSDISMDEQVELKFVDDSDTSYEEKEKLDDFENPFEIEREKERMSNPYYLGEEDEERTKNSKDLLDLNEEESSDKKPETIRLNRTDNSLNSLSLSTTEISRKKKKGKKKNRVQVLSDEPVIEAAPKRKDAFQKPHDNHSTQNPLKKDKINLRMHSQLENFDFSNFGQSSNAGRGSQEEGNLRKEDELELSRLEANLIVKDEKDNLSDTEEVIVIKKKKKGKKSKSKNKLKTKAKNSPEPNEFLRDQSTDI

SEQ ID NO: 179 - DNA, 2430 bp, Saccharomyces cerevisiae
atggtagattcaattcaccgtattgcatcggcgttggatacggccaaagtaataacgagggaagctgccgcggtagccacctctaagctgggtgaatcctcctatacttattattctcaaaacatcaatcctcaacagttagtcaccttgttaaattctaggaactctagagaagttagagatgcaatgaagagaataatatctataatggcttccgatgatgactctattgacgttcaattatactttgctgatgttgtaaagaatatcaccactaatgacaccaaagtgaaaagacttattcacctgtatttacttagatttgcagaaaatgacccaaacctgaccctgttatctattaattctcttcaaaaatcattgtctgattcgaattccgaactgagatgctttgctttgagtgccctttctgacatgaaaatgtcatcattagcacctataattttgcatactgtcaagaaattggttacagatccatctgcaatggttcgtggtgaagtcgccttggccattatcaaattatatagggctggaaagaatgactatcatgaagaattgttggatattctgaaagaattaatggcagatacagatcctaaggtgatatcctgtgctgtcctagcttacaaagaatgttatgcggatcacttggagctattgcatggacattttcgcagatattgtagaataattaagcaactagattcgtggtcacaatcatatttaattgagctgctaatcaagtactgtaagcagtatttaccaaaaccaactgtggtcgataaatcatcagaaggttccccaaggagttgtcctttaccagataaatacaacgagattgaatacccatcttacgaggtggtaaatgaccctgatttagatttatttctacagagtttgaattgcttaatttatagttccaaccctacagtgattttatcgtgttgcaatgcgctatatcagttagcttcaccattgcagatgaaaaatactaaatttattgaagcattggttagaacggtaaccatgacagaaaaccaaggtaacaaagaaatgcttttacaagcaattcacttcttatcgatcttagaccagacactatttttaccctacaccaagaaattttacgttttccccaaagatcctattgtggcatcaatttggaagatccaaattttgtccacgttaataaatgaatcaaacgttaaagaaatattcaaagaattgaaatattatgttgccagtgctcatttcccagaaaatgttgttattatggcggttaagtcattatctcgatgtggccaattgtcaacgagttgggaatcacatgtaatgaagtggttaattgatcatatggaatcccacaacctctctgcttctgtcctagatgcatacgtgaatgttatcaggatgctggtgcaaaaaaatcctacaaaacatcttcgcataatcttcaagcttgcagatttattaacagttcaaacgagtttggctgataatgctcgtgcaggtattgtttggttatttggtgaaattgcctcgattgaatttaagatatgtccggacgttttgaggaggctaatccagaatttttcaaatgagggtcctgagacaagatgtcagatcttagtgttatcagcaaaactgttgtcatatgacattgataattttaagcaagcgcaagttactggaagcgaagaaaataaccaaaatcccccatactatgattttagtggttcaagaatctctcaaatgtacaatgcggtcctttacttggcaaaatatgatgacgaatttgatattagggatagagccaggatgatttcatccttgtttgattcagggaaatatgaaattgtgtcactactattacaagcacctaaacctacggcaagaagtgacgattttatcgtttctgcaagattggaaacacataccccagaaataaaagaattttttagaatgcttccttggaatactgaaattactgaggttggcgagacaggtaacgatattagagaaggcgcagaattgaaagactataacaaatacaaaaaaagtttttcatcgcagtcttttattaccaacaactcagcaagatctttcacatctagctccaacgcaaaattgactgggatcaatgacggcgatagcaatagcatctcaggtaaaggtaacgtaaacaccttcacatctcaaaacgggaagaaatatcgtttgcaaagcctggacgagtttttttccgacattccagaaaggaagagtaaaccaaggaaaattataaaggtggtggaagaaagcagtgacgaggatgaagacgaatcggaagagagcagtgacgatgatgagtatagtgactcttctttgggaacgtcttcttcgggaacgtcttcttcgcatctggagctttag

SEQ ID NO: 180 - protein, 809 aa, Saccharomyces cerevisiae
MVDSIHRIASALDTAKVITREAAAVATSKLGESSYTYYSQNINPQQLVTLLNSRNSREVRDAMKRIISIMASDDDSIDVQLYFADVVKNITTNDTKVKRLIHLYLLRFAENDPNLTLLSINSLQKSLSDSNSELRCFALSALSDMKMSSLAPIILHTVKKLVTDPSAMVRGEVALAIIKLYRAGKNDYHEELLDILKELMADTDPKVISCAVLAYKECYADHLELLHGHFRRYCRIIKQLDSWSQSYLIELLIKYCKQYLPKPTVVDKSSEGSPRSCPLPDKYNEIEYPSYEVVNDPDLDLFLQSLNCLIYSSNPTVILSCCNALYQLASPLQMKNTKFIEALVRTVTMTENQGNKEMLLQAIHFLSILDQTLFLPYTKKFYVFPKDPIVASIWKIQILSTLINESNVKEIFKELKYYVASAHFPENVVIMAVKSLSRCGQLSTSWESHVMKWLIDHMESHNLSASVLDAYVNVIRMLVQKNPTKHLRIIFKLADLLTVQTSLADNARAGIVWLFGEIASIEFKICPDVLRRLIQNFSNEGPETRCQILVLSAKLLSYDIDNFKQAQVTGSEENNQNPPYYDFSGSRISQMYNAVLYLAKYDDEFDIRDRARMISSLFDSGKYEIVSLLLQAPKPTARSDDFIVSARLETHTPEIKEFFRMLPWNTEITEVGETGNDIREGAELKDYNKYKKSFSSQSFITNNSARSFTSSSNAKLTGINDGDSNSISGKGNVNTFTSQNGKKYRLQSLDEFFSDIPERKSKPRKIIKVVEESSDEDEDESEESSDDDEYSDSSLGTSSSGTSSSHLEL

SEQ ID NO: 181 - DNA, 894 bp, Synechococcus sp.
atggtcgcacaaactttcaacctggatacctacttatcccaaagacaacaacaagttgaagaggccctaagtgctgctcttgtgccagcttatcctgagagaatatacgaagctatgagatactccctcctggcaggtggcaaaagattaagacctatcttatgtttagctgcttgcgaattggcaggtggttctgttgaacaagccatgccaactgcgtgtgcacttgaaatgatccatacaatgtcactaattcatgatgacctgccagccatggataacgatgatttcagaagaggaaagccaactaatcacaaggtgttcggggaagatatagccatcttagcgggtgatgcgcttttagcttacgcttttgaacatattgcttctcaaacaagaggagtaccacctcaattggtgctacaagttattgctagaatcggacacgccgttgctgcaacaggcctcgttggaggccaagtcgtagaccttgaatctgaaggtaaagctatttccttagaaacattggagtatattcactcacataagactggagccttgctggaagcatcagttgtctcaggcggtattctcgcaggggcagatgaagagcttttggccagattgtctcattacgctagagatataggcttggcttttcaaatcgtcgatgatatcctggatgttactgctacatctgaacagttggggaaaaccgctggtaaagaccaggcagccgcaaaggcaacttatccaagtctattgggtttagaagcctctagacagaaagcggaagagttgattcaatctgctaaggaagccttaagaccttacggttcacaagcagagccactcctagcgctggcagacttcatcacacgtcgtcagcattaa

SEQ ID NO: 182 - protein, 297 aa, Synechococcus sp.
MVAQTFNLDTYLSQRQQQVEEALSAALVPAYPERIYEAMRYSLLAGGKRLRPILCLAACELAGGSVEQAMPTACALEMIHTMSLIHDDLPAMDNDDFRRGKPTNHKVFGEDIAILAGDALLAYAFEHIASQTRGVPPQLVLQVIARIGHAVAATGLVGGQVVDLESEGKAISLETLEYIHSHKTGALLEASVVSGGILAGADEELLARLSHYARDIGLAFQIVDDILDVTATSEQLGKTAGKDQAAAKATYPSLLGLEASRQKAEELIQSAKEALRPYGSQAEPLLALADFITRRQH

SEQ ID NO: 183 - DNA, 2340 bp, Zea mays
gcacagcacacatcagaatccgcagctgtcgcaaagggcagcagtttgacccctatagtgagaactgacgctgagtcaaggagaacaagatggccaaccgatgacgatgacgccgaacctttagtggatgagatcagggcaatgcttacttccatgtctgatggtgacatttccgtgagcgcatacgatacagcctgggtcggattggttccaagattagacggcggtgaaggtcctcaatttccagcagctgtgagatggataagaaataaccagttgcctgacggaagttggggcgatgccgcattattctctgcctatgacaggcttatcaatacccttgcctgcgttgtaactttgacaaggtggtccctagaaccagagatgagaggtagaggactatcttttttgggtaggaacatgtggaaattagcaactgaagatgaagagtcaatgcctattggcttcgaattagcatttccatctttgatagagcttgctaagagcctaggtgtccatgacttcccttatgatcaccaggccctacaaggaatctactcttcaagagagatcaaaatgaagaggattccaaaagaagtgatgcataccgttccaacatcaatattgcacagtttggagggtatgcctggcctagattgggctaaactacttaaactacagagcagcgacggaagttttttgttctcaccagctgccactgcatatgctttaatgaataccggagatgacaggtgttttagctacatcgatagaacagtaaagaaattcaacggcggcgtccctaatgtttatccagtggatctatttgaacatatttgggccgttgatagacttgaaagattaggaatctccaggtacttccaaaaggagatcgaacaatgcatggattatgtaaacaggcattggactgaggacggtatttgttgggcaaggaactctgatgtcaaagaggtggacgacacagctatggcctttagacttcttaggttgcacggctacagcgtcagtcctgatgtgtttaaaaacttcgaaaaggacggtgaatttttcgcatttgtcggacagtctaatcaagctgttaccggtatgtacaacttaaacagagcaagccagatatccttcccaggcgaggatgtgcttcatagagctggtgccttctcatatgagttcttgaggagaaaagaagcagagggagctttgagggacaagtggatcatttctaaagatctacctggtgaagttgtgtatactttggattttccatggtacggcaacttacctagagtcgaggccagagactacctagagcaatacggaggtggtgatgacgtttggattggcaagacattgtataggatgccacttgtaaacaatgatgtatatttggaattggcaagaatggatttcaaccactgccaggctttgcatcagttagagtggcaaggactaaaaagatggtatactgaaaataggttgatggactttggtgtcgcccaagaagatgcccttagagcttattttcttgcagccgcatctgtttacgagccttgtagagctgccgagaggcttgcatgggctagagccgcaatactagctaacgccgtgagcacccacttaagaaatagcccatcattcagagaaaggttagagcattctcttaggtgtagacctagtgaagagacagatggctcctggtttaactcctcaagtggctctgatgcagttttagtaaaggctgtcttaagacttactgattcattagccagggaagcacagccaatccatggaggtgacccagaagatattatacacaagttgttaagatctgcttgggccgagtgggttagggaaaaggcagacgctgccgatagcgtgtgcaatggtagttctgcagtagaacaagagggatcaagaatggtccatgataaacagacctgtctattattggctagaatgatcgaaatttctgccggtagggcagctggtgaagcagccagtgaggacggcgatagaagaataattcaattaacaggctccatctgcgacagtcttaagcaaaaaatgctagtttcacaggaccctgaaaaaaatgaagagatgatgtctcacgtggatgacgaattgaagttgaggattagagagttcgttcaatatttgcttagactaggtgaaaaaaagactggatctagcgaaaccaggcaaacatttttaagtatagtgaaatcatgttactatgctgctcattgcccacctcatgtcgttgatagacacattagtagagtgattttcgagccagtaagtgccgcaaagtaaccgcgg

SEQ ID NO: 184 - protein, 777 aa, Zea mays
AQHTSESAAVAKGSSLTPIVRTDAESRRTRWPTDDDDAEPLVDEIRAMLTSMSDGDISVSAYDTAWVGLVPRLDGGEGPQFPAAVRWIRNNQLPDGSWGDAALFSAYDRLINTLACVVTLTRWSLEPEMRGRGLSFLGRNMWKLATEDEESMPIGFELAFPSLIELAKSLGVHDFPYDHQALQGIYSSREIKMKRIPKEVMHTVPTSILHSLEGMPGLDWAKLLKLQSSDGSFLFSPAATAYALMNTGDDRCFSYIDRTVKKFNGGVPNVYPVDLFEHIWAVDRLERLGISRYFQKEIEQCMDYVNRHWTEDGICWARNSDVKEVDDTAMAFRLLRLHGYSVSPDVFKNFEKDGEFFAFVGQSNQAVTGMYNLNRASQISFPGEDVLHRAGAFSYEFLRRKEAEGALRDKWIISKDLPGEVVYTLDFPWYGNLPRVEARDYLEQYGGGDDVWIGKTLYRMPLVNNDVYLELARMDFNHCQALHQLEWQGLKRWYTENRLMDFGVAQEDALRAYFLAAASVYEPCRAAERLAWARAAILANAVSTHLRNSPSFRERLEHSLRCRPSEETDGSWFNSSSGSDAVLVKAVLRLTDSLAREAQPIHGGDPEDIIHKLLRSAWAEWVREKADAADSVCNGSSAVEQEGSRMVHDKQTCLLLARMIEISAGRAAGEAASEDGDRRIIQLTGSICDSLKQKMLVSQDPEKNEEMMSHVDDELKLRIREFVQYLLRLGEKKTGSSETRQTFLSIVKSCYYAAHCPPHVVDRHISRVIFEPVSAAK

SEQ ID NO: 185 - DNA, 2358 bp, Arabidopsis thaliana
atgtctattaatttgagatcttccggttgtagctccccaataagcgcaactttggaaaggggtctagactctgaagttcaaacaagagcaaacaatgtatcttttgagcagaccaaagagaagatcaggaaaatgcttgagaaggtcgagttgagcgtgagtgcctatgacactagttgggtagctatggtcccatcaccatccagtcaaaacgcacctcttttcccacagtgcgtcaaatggctacttgataatcaacatgaggacggctcttggggattggataaccacgaccatcagagcttaaagaaagatgtgttgtcatccacattagcctctatcctagctcttaagaaatggggaataggcgaaagacagatcaataagggtctacagttcattgaattaaactctgcactagttaccgatgaaactatacaaaaacctacaggtttcgacatcatttttccaggaatgattaagtacgccagggaccttaatttgaccatacctcttggctcagaagtagtcgacgatatgatcaggaaaagagatctagacttaaagtgtgatagcgagaaattcagcaaaggtagagaggcttatcttgcctatgttcttgaaggaactaggaacttgaaggactgggacttaattgtgaaatatcagagaaagaacggtagtctatttgatagtccagctacaaccgccgcagctttcactcaatttggcaatgacggttgcttgaggtacttatgttcacttttacagaaattcgaggccgcagtgcctagtgtatatccatttgatcaatacgctagattaagcataatcgtcactttagaatcattgggaattgacagagatttcaagactgagataaaaagcatattggatgagacctataggtactggcttagaggtgacgaagaaatttgcctagatttggccacatgtgcacttgcttttaggttgcttttagcccacggctatgacgtgtcatacgatcctctaaagccatttgcagaggaatctggtttcagcgatacccttgagggatatgttaaaaacaccttttccgtattagagcttttcaaggctgcccaaagttaccctcatgagagtgctttgaaaaagcagtgttgctggacaaaacaatatctagaaatggaactaagttcatgggttaaaacaagcgttagggacaagtacttgaaaaaggaagtggaggatgctttggcatttccatcatatgcctctttagaaagaagtgaccacagaaggaaaattcttaatggctcagcagttgaaaacacaagagtaaccaagacctcttacaggttgcataatatatgtacatcagatatcttaaaacttgctgtcgacgatttcaacttttgccaatctattcatagagaggaaatggaaagattggatagatggatagtggagaatagactacaggaattaaagttcgccagacaaaaattggcttactgttactttagtggcgctgccacactattctctccagaattgtctgacgcaaggatctcatgggctaagggaggtgttctaaccacagtagtcgatgacttttttgatgttggcggtagtaaagaagagcttgagaacttaattcacttggtggaaaagtgggatcttaatggagttcctgaatactcttcagagcatgtagaaataattttctctgtcctaagagacactatcttagaaaccggtgataaagcctttacatatcagggcagaaacgttactcaccatattgtgaaaatatggttggacttacttaagagcatgctaagggaggctgaatggtccagtgacaaatcaaccccatctttggaagattacatggagaatgcctatatcagcttcgcattaggtcctattgtattgccagctacataccttataggacctccactacctgaaaagactgtcgactcccaccaatataatcaattatacaaattggttagtaccatgggtagactattaaacgatatccagggctttaagagggaatcagccgagggaaaacttaatgcagtgtctctacatatgaagcatgaaagagacaacagaagcaaagaggttattatagaatccatgaaaggattggctgaaaggaaaagagaggaattacacaaacttgtactagaagagaaaggtagtgtcgttccaagagaatgcaaggaagccttcttaaaaatgtcaaaagtgttgaaccttttttataggaaggatgatggcttcacatctaacgacttgatgagccttgtgaaatccgtcatctacgagcctgtttcacttcaaaaggagagtctaacttga

SEQ ID NO: 186 - protein, 785 aa, Arabidopsis thaliana
MSINLRSSGCSSPISATLERGLDSEVQTRANNVSFEQTKEKIRKMLEKVELSVSAYDTSWVAMVPSPSSQNAPLFPQCVKWLLDNQHEDGSWGLDNHDHQSLKKDVLSSTLASILALKKWGIGERQINKGLQFIELNSALVTDETIQKPTGFDIIFPGMIKYARDLNLTIPLGSEVVDDMIRKRDLDLKCDSEKFSKGREAYLAYVLEGTRNLKDWDLIVKYQRKNGSLFDSPATTAAAFTQFGNDGCLRYLCSLLQKFEAAVPSVYPFDQYARLSIIVTLESLGIDRDFKTEIKSILDETYRYWLRGDEEICLDLATCALAFRLLLAHGYDVSYDPLKPFAEESGFSDTLEGYVKNTFSVLELFKAAQSYPHESALKKQCCWTKQYLEMELSSWVKTSVRDKYLKKEVEDALAFPSYASLERSDHRRKILNGSAVENTRVTKTSYRLHNICTSDILKLAVDDFNFCQSIHREEMERLDRWIVENRLQELKFARQKLAYCYFSGAATLFSPELSDARISWAKGGVLTTVVDDFFDVGGSKEELENLIHLVEKWDLNGVPEYSSEHVEIIFSVLRDTILETGDKAFTYQGRNVTHHIVKIWLDLLKSMLREAEWSSDKSTPSLEDYMENAYISFALGPIVLPATYLIGPPLPEKTVDSHQYNQLYKLVSTMGRLLNDIQGFKRESAEGKLNAVSLHMKHERDNRSKEVIIESMKGLAERKREELHKLVLEEKGSVVPRECKEAFLKMSKVLNLFYRKDDGFTSNDLMSLVKSVIYEPVSLQKESLT

SEQ ID NO: 187 - DNA, 1542 bp, Artificial Sequence
  Codon-optimized KO
atggatgctgtgacgggtttgttaactgtcccagcaaccgctataactattggtggaactgctgtagcattggcggtagcgctaatcttttggtacctgaaatcctacacatcagctagaagatcccaatcaaatcatcttccaagagtgcctgaagtcccaggtgttccattgttaggaaatctgttacaattgaaggagaaaaagccatacatgacttttacgagatgggcagcgacatatggacctatctatagtatcaaaactggggctacaagtatggttgtggtatcatctaatgagatagccaaggaggcattggtgaccagattccaatccatatctacaaggaacttatctaaagccctgaaagtacttacagcagataagacaatggtcgcaatgtcagattatgatgattatcataaaacagttaagagacacatactgaccgccgtcttgggtcctaatgcacagaaaaagcatagaattcacagagatatcatgatggataacatatctactcaacttcatgaattcgtgaaaaacaacccagaacaggaagaggtagaccttagaaaaatctttcaatctgagttattcggcttagctatgagacaagccttaggaaaggatgttgaaagtttgtacgttgaagacctgaaaatcactatgaatagagacgaaatctttcaagtccttgttgttgatccaatgatgggagcaatcgatgttgattggagagacttctttccatacctaaagtgggtcccaaacaaaaagttcgaaaatactattcaacaaatgtacatcagaagagaagctgttatgaaatctttaatcaaagagcacaaaaagagaatagcgtcaggcgaaaagctaaatagttatatcgattaccttttatctgaagctcaaactttaaccgatcagcaactattgatgtccttgtgggaaccaatcattgaatcttcagatacaacaatggtcacaacagaatgggcaatgtacgaattagctaaaaaccctaaattgcaagataggttgtacagagacattaagtccgtctgtggatctgaaaagataaccgaagagcatctatcacagctgccttacattacagctattttccacgaaacactgagaagacactcaccagttcctatcattcctctaagacatgtacatgaagataccgttctaggcggctaccatgttcctgctggcacagaacttgccgttaacatctacggttgcaacatggacaaaaacgtttgggaaaatccagaggaatggaacccagaaagattcatgaaagagaatgagacaattgattttcaaaagacgatggccttcggtggtggtaagagagtttgtgctggttccttgcaagcccttttaactgcatctattgggattgggagaatggttcaagagttcgaatggaaactgaaggatatgactcaagaggaagtgaacacgataggcctaactacacaaatgttaagaccattgagagctattatcaaacctaggatctaa

SEQ ID NO: 188 - protein, 513 aa, Arabidopsis thaliana
MDAVTGLLTVPATAITIGGTAVALAVALIFWYLKSYTSARRSQSNHLPRVPEVPGVPLLGNLLQLKEKKPYMTFTRWAATYGPIYSIKTGATSMVVVSSNEIAKEALVTRFQSISTRNLSKALKVLTADKTMVAMSDYDDYHKTVKRHILTAVLGPNAQKKHRIHRDIMMDNISTQLHEFVKNNPEQEEVDLRKIFQSELFGLAMRQALGKDVESLYVEDLKITMNRDEIFQVLVVDPMMGAIDVDWRDFFPYLKWVPNKKFENTIQQMYIRREAVMKSLIKEHKKRIASGEKLNSYIDYLLSEAQTLTDQQLLMSLWEPIIESSDTTMVTTEWAMYELAKNPKLQDRLYRDIKSVCGSEKITEEHLSQLPYITAIFHETLRRHSPVPIIPLRHVHEDTVLGGYHVPAGTELAVNIYGCNMDKNVWENPEEWNPERFMKENETIDFQKTMAFGGGKRVCAGSLQALLTASIGIGRMVQEFEWKLKDMTQEEVNTIGLTTQMLRPLRAIIKPRI

SEQ ID NO: 189 - DNA, 2139 bp, Artificial Sequence
  Codon-optimized ATR2
atgtcttcctcttcctcttccagtacctctatgattgatttgatggctgctattattaaaggtgaaccagttatcgtctccgacccagcaaatgcctctgcttatgaatcagttgctgcagaattgtcttcaatgttgatcgaaaacagacaattcgccatgatcgtaactacatcaatcgctgttttgatcggttgtattgtcatgttggtatggagaagatccggtagtggtaattctaaaagagtcgaacctttgaaaccattagtaattaagccaagagaagaagaaatagatgacggtagaaagaaagttacaatatttttcggtacccaaactggtacagctgaaggttttgcaaaagccttaggtgaagaagctaaggcaagatacgaaaagactagattcaagatagtcgatttggatgactatgccgctgatgacgatgaatacgaagaaaagttgaagaaagaagatgttgcatttttctttttggcaacctatggtgacggtgaaccaactgacaatgcagccagattctacaaatggtttacagagggtaatgatcgtggtgaatggttgaaaaacttaaagtacggtgttttcggtttgggtaacagacaatacgaacatttcaacaaagttgcaaaggttgtcgacgatattttggtcgaacaaggtgctcaaagattagtccaagtaggtttgggtgacgatgaccaatgtatagaagatgactttactgcctggagagaagctttgtggcctgaattagacacaatcttgagagaagaaggtgacaccgccgttgctaccccatatactgctgcagtattagaatacagagtttccatccatgatagtgaagacgcaaagtttaatgatatcactttggccaatggtaacggttatacagttttcgatgcacaacacccttacaaagctaacgttgcagtcaagagagaattacatacaccagaatccgacagaagttgtatacacttggaatttgatatcgctggttccggtttaaccatgaagttgggtgaccatgtaggtgttttatgcgacaatttgtctgaaactgttgatgaagcattgagattgttggatatgtcccctgacacttattttagtttgcacgctgaaaaagaagatggtacaccaatttccagttctttaccacctccattccctccatgtaacttaagaacagccttgaccagatacgcttgcttgttatcatcccctaaaaagtccgccttggttgctttagccgctcatgctagtgatcctactgaagcagaaagattgaaacacttagcatctccagccggtaaagatgaatattcaaagtgggtagttgaatctcaaagatcattgttagaagttatggcagaatttccatctgccaagcctccattaggtgtcttctttgctggtgtagcacctagattgcaaccaagattctactcaatcagttcttcacctaagatcgctgaaactagaattcatgttacatgtgcattagtctacgaaaagatgccaaccggtagaattcacaagggtgtatgctctacttggatgaaaaatgctgttccttacgaaaaatcagaaaagttgttcttaggtagaccaatcttcgtaagacaatcaaacttcaagttgccttctgattcaaaggttccaataatcatgataggtcctggtacaggtttagccccattcagaggtttcttgcaagaaagattggctttagttgaatctggtgtcgaattaggtccttcagttttgttctttggttgtagaaacagaagaatggatttcatctatgaagaagaattgcaaagattcgtcgaatctggtgcattggccgaattatctgtagctttttcaagagaaggtccaactaaggaatacgttcaacataagatgatggataaggcatccgacatatggaacatgatcagtcaaggtgcttatttgtacgtttgcggtgacgcaaagggtatggccagagatgtccatagatctttgcacacaattgctcaagaacaaggttccatggatagtaccaaagctgaaggtttcgtaaagaacttacaaacttccggtagatacttgagagatgtctggtga

SEQ ID NO: 190 - protein, 712 aa, Arabidopsis thaliana
MSSSSSSSTSMIDLMAAIIKGEPVIVSDPANASAYESVAAELSSMLIENRQFAMIVTTSIAVLIGCIVMLVWRRSGSGNSKRVEPLKPLVIKPREEEIDDGRKKVTIFFGTQTGTAEGFAKALGEEAKARYEKTRFKIVDLDDYAADDDEYEEKLKKEDVAFFFLATYGDGEPTDNAARFYKWFTEGNDRGEWLKNLKYGVFGLGNRQYEHFNKVAKVVDDILVEQGAQRLVQVGLGDDDQCIEDDFTAWREALWPELDTILREEGDTAVATPYTAAVLEYRVSIHDSEDAKFNDITLANGNGYTVFDAQHPYKANVAVKRELHTPESDRSCIHLEFDIAGSGLTMKLGDHVGVLCDNLSETVDEALRLLDMSPDTYFSLHAEKEDGTPISSSLPPPFPPCNLRTALTRYACLLSSPKKSALVALAAHASDPTEAERLKHLASPAGKDEYSKWVVESQRSLLEVMAEFPSAKPPLGVFFAGVAPRLQPRFYSISSSPKIAETRIHVTCALVYEKMPTGRIHKGVCSTWMKNAVPYEKSEKLFLGRPIFVRQSNFKLPSDSKVPIIMIGPGTGLAPFRGFLQERLALVESGVELGPSVLFFGCRNRRMDFIYEEELQRFVESGALAELSVAFSREGPTKEYVQHKMMDKASDIWNMISQGAYLYVCGDAKGMARDVHRSLHTIAQEQGSMDSTKAEGFVKNLQTSGRYLRDVW

SEQ ID NO: 191 - DNA, 1503 bp, Stevia rebaudiana
atggaagcctcttacctatacatttctattttgcttttactggcatcatacctgttcaccactcaacttagaaggaagagcgctaatctaccaccaaccgtgtttccatcaataccaatcattggacacttatacttactcaaaaagcctctttatagaactttagcaaaaattgccgctaagtacggaccaatactgcaattacaactcggctacagacgtgttctggtgatttcctcaccatcagcagcagaagagtgctttaccaataacgatgtaatcttcgcaaatagacctaagacattgtttggcaaaatagtgggtggaacatcccttggcagtttatcctacggcgatcaatggcgtaatctaaggagagtagcttctatcgaaatcctatcagttcataggttgaacgaatttcatgatatcagagtggatgagaacagattgttaattagaaaacttagaagttcatcttctcctgttactcttataacagtcttttatgctctaacattgaacgtcattatgagaatgatctctggcaaaagatatttcgacagtggggatagagaattggaggaggaaggtaagagatttcgagaaatcttagacgaaacgttgcttctagccggtgcttctaatgttggcgactacttaccaatattgaactggttgggagttaagtctcttgaaaagaaattgatcgctttgcagaaaaagagagatgactttttccagggtttgattgaacaggttagaaaatctcgtggtgctaaagtaggcaaaggtagaaaaacgatgatcgaactcttattatctttgcaagagtcagaacctgagtactatacagatgctatgataagatcttttgtcctaggtctgctggctgcaggtagtgatacttcagcgggcactatggaatgggccatgagcttactggtcaatcacccacatgtattgaagaaagctcaagctgaaatcgatagagttatcggtaataacagattgattgacgagtcagacattggaaatatcccttacatcgggtgtattatcaatgaaactctaagactctatccagcagggccattgttgttcccacatgaaagttctgccgactgcgttatttccggttacaatatacctagaggtacaatgttaatcgtaaaccaatgggcgattcatcacgatcctaaagtctgggatgatcctgaaacctttaaacctgaaagatttcaaggattagaaggaactagagatggtttcaaacttatgccattcggttctgggagaagaggatgtccaggtgaaggtttggcaataaggctgttagggatgacactaggctcagtgatccaatgttttgattgggagagagtaggagatgagatggttgacatgacagaaggtttgggtgtcacacttcctaaggccgttccattagttgccaaatgtaagccacgttccgaaatgactaatctcctatccgaactttaa

SEQ ID NO: 192 - protein, 500 aa, Stevia rebaudiana
MEASYLYISILLLLASYLFTTQLRRKSANLPPTVFPSIPIIGHLYLLKKPLYRTLAKIAAKYGPILQLQLGYRRVLVISSPSAAEECFTNNDVIFANRPKTLFGKIVGGTSLGSLSYGDQWRNLRRVASIEILSVHRLNEFHDIRVDENRLLIRKLRSSSSPVTLITVFYALTLNVIMRMISGKRYFDSGDRELEEEGKRFREILDETLLLAGASNVGDYLPILNWLGVKSLEKKLIALQKKRDDFFQGLIEQVRKSRGAKVGKGRKTMIELLLSLQESEPEYYTDAMIRSFVLGLLAAGSDTSAGTMEWAMSLLVNHPHVLKKAQAEIDRVIGNNRLIDESDIGNIPYIGCIINETLRLYPAGPLLFPHESSADCVISGYNIPRGTMLIVNQWAIHHDPKVWDDPETFKPERFQGLEGTRDGFKLMPFGSGRRGCPGEGLAIRLLGMTLGSVIQCFDWERVGDEMVDMTEGLGVTLPKAVPLVAKCKPRSEMTNLLSEL

SEQ ID NO: 193 - DNA, 2124 bp, Stevia rebaudiana
atgcaatctaactccgtgaagatttcgccgcttgatctggtaactgcgctgtttagcggcaaggttttggacacatcgaacgcatcggaatcgggagaatctgctatgctgccgactatagcgatgattatggagaatcgtgagctgttgatgatactcacaacgtcggttgctgtattgatcggatgcgttgtcgttttggtgtggcggagatcgtctacgaagaagtcggcgttggagccaccggtgattgtggttccgaagagagtgcaagaggaggaagttgatgatggtaagaagaaagttacggttttcttcggcacccaaactggaacagctgaaggcttcgctaaggcacttgttgaggaagctaaagctcgatatgaaaaggctgtctttaaagtaattgatttggatgattatgctgctgatgacgatgagtatgaggagaaactaaagaaagaatctttggcctttttctttttggctacgtatggagatggtgagccaacagataatgctgccagattttataaatggtttactgagggagatgcgaaaggagaatggcttaataagcttcaatatggagtatttggtttgggtaacagacaatatgaacattttaacaagatcgcaaaagtggttgatgatggtcttgtagaacagggtgcaaagcgtcttgttcctgttggacttggagatgatgatcaatgtattgaagatgacttcaccgcatggaaagagttagtatggccggagttggatcaattacttcgtgatgaggatgacacaactgttgctactccatacacagctgctgttgcagaatatcgcgttgtttttcatgaaaaaccagacgcgctttctgaagattatagttatacaaatggccatgctgttcatgatgctcaacatccatgcagatccaacgtggctgtcaaaaaggaacttcatagtcctgaatctgaccggtcttgcactcatcttgaatttgacatctcgaacaccggactatcatatgaaactggggaccatgttggagtttactgtgaaaacttgagtgaagttgtgaatgatgctgaaagattagtaggattaccaccagacacttactcctccatccacactgatagtgaagacgggtcgccacttggcggagcctcattgccgcctcctttcccgccatgcactttaaggaaagcattgacgtgttatgctgatgttttgagttctcccaagaagtcggctttgcttgcactagctgctcatgccaccgatcccagtgaagctgatagattgaaatttcttgcatcccccgccggaaaggatgaatattctcaatggatagttgcaagccaaagaagtctccttgaagtcatggaagcattcccgtcagctaagccttcacttggtgttttctttgcatctgttgccccgcgcttacaaccaagatactactctatttcttcctcacccaagatggcaccggataggattcatgttacatgtgcattagtctatgagaaaacacctgcaggccgcatccacaaaggagtttgttcaacttggatgaagaacgcagtgcctatgaccgagagtcaagattgcagttgggccccaatatacgtccgaacatccaatttcagactaccatctgaccctaaggtcccggttatcatgattggacctggcactggtttggctccttttagaggtttccttcaagagcggttagctttaaaggaagccggaactgacctcggtttatccattttattcttcggatgtaggaatcgcaaagtggatttcatatatgaaaacgagcttaacaactttgtggagactggtgctctttctgagcttattgttgctttctcccgtgaaggcccgactaaggaatatgtgcaacacaagatgagtgagaaggcttcggatatctggaacttgctttctgaaggagcatatttatacgtatgtggtgatgccaaaggcatggccaaagatgtacatcgaaccctccacacaattgtgcaagaacagggatctcttgactcgtcaaaggcagaactctacgtgaagaatctacaaatgtcaggaagatacctccgtgacgtttggtaa

SEQ ID NO: 194 - protein, 707 aa, Stevia rebaudiana
MQSNSVKISPLDLVTALFSGKVLDTSNASESGESAMLPTIAMIMENRELLMILTTSVAVLIGCVVVLVWRRSSTKKSALEPPVIVVPKRVQEEEVDDGKKKVTVFFGTQTGTAEGFAKALVEEAKARYEKAVFKVIDLDDYAADDDEYEEKLKKESLAFFFLATYGDGEPTDNAARFYKWFTEGDAKGEWLNKLQYGVFGLGNRQYEHFNKIAKVVDDGLVEQGAKRLVPVGLGDDDQCIEDDFTAWKELVWPELDQLLRDEDDTTVATPYTAAVAEYRVVFHEKPDALSEDYSYTNGHAVHDAQHPCRSNVAVKKELHSPESDRSCTHLEFDISNTGLSYETGDHVGVYCENLSEVVNDAERLVGLPPDTYSSIHTDSEDGSPLGGASLPPPFPPCTLRKALTCYADVLSSPKKSALLALAAHATDPSEADRLKFLASPAGKDEYSQWIVASQRSLLEVMEAFPSAKPSLGVFFASVAPRLQPRYYSISSSPKMAPDRIHVTCALVYEKTPAGRIHKGVCSTWMKNAVPMTESQDCSWAPIYVRTSNFRLPSDPKVPVIMIGPGTGLAPFRGFLQERLALKEAGTDLGLSILFFGCRNRKVDFIYENELNNFVETGALSELIVAFSREGPTKEYVQHKMSEKASDIWNLLSEGAYLYVCGDAKGMAKDVHRTLHTIVQEQGSLDSSKAELYVKNLQMSGRYLRDVW

SEQ ID NO: 195 - DNA, 1446 bp, Artificial Sequence
  Codon-optimized UGT85C2
atggatgcaatggcaactactgagaaaaagcctcatgtgatcttcattccatttcctgcacaatctcacataaaggcaatgctaaagttagcacaactattacaccataagggattacagataactttcgtgaataccgacttcatccataatcaatttctggaatctagtggccctcattgtttggacggagccccagggtttagattcgaaacaattcctgacggtgtttcacattccccagaggcctccatcccaataagagagagtttactgaggtcaatagaaaccaactttttggatcgtttcattgacttggtcacaaaacttccagacccaccaacttgcataatctctgatggctttctgtcagtgtttactatcgacgctgccaaaaagttgggtatcccagttatgatgtactggactcttgctgcatgcggtttcatgggtttctatcacatccattctcttatcgaaaagggttttgctccactgaaagatgcatcatacttaaccaacggctacctggatactgttattgactgggtaccaggtatggaaggtataagacttaaagattttcctttggattggtctacagaccttaatgataaagtattgatgtttactacagaagctccacaaagatctcataaggtttcacatcatatctttcacacctttgatgaattggaaccatcaatcatcaaaaccttgtctctaagatacaatcatatctacactattggtccattacaattacttctagatcaaattcctgaagagaaaaagcaaactggtattacatccttacacggctactctttagtgaaagaggaaccagaatgttttcaatggctacaaagtaaagagcctaattctgtggtctacgtcaacttcggaagtacaacagtcatgtccttggaagatatgactgaatttggttggggccttgctaattcaaatcattactttctatggattatcaggtccaatttggtaataggggaaaacgccgtattacctccagaattggaggaacacatcaaaaagagaggtttcattgcttcctggtgttctcaggaaaaggtattgaaacatccttctgttggtggtttccttactcattgcggttggggctctacaatcgaatcactaagtgcaggagttccaatgatttgttggccatattcatgggaccaacttacaaattgtaggtatatctgtaaagagtgggaagttggattagaaatgggaacaaaggttaaacgtgatgaagtgaaaagattggttcaggagttgatgggggaaggtggccacaagatgagaaacaaggccaaagattggaaggaaaaagccagaattgctattgctcctaacgggtcatcctctctaaacattgataagatggtcaaagagattacagtcttagccagaaactaa

SEQ ID NO: 196 - protein, 481 aa, Stevia rebaudiana
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 197 - DNA, 1555 bp, Stevia rebaudiana
atggcggaacaacaaaagatcaagaaatcaccacacgttctactcatcccattccctttacaaggccatataaaccctttcatccagtttggcaaacgattaatctccaaaggtgtcaaaacaacacttgttaccaccatccacaccttaaactcaaccctaaaccacagtaacaccaccaccacctccatcgaaatccaagcaatttccgatggttgtgatgaaggcggttttatgagtgcaggagaatcatatttggaaacattcaaacaagttgggtctaaatcactagctgacttaatcaagaagcttcaaagtgaaggaaccacaattgatgcaatcatttatgattctatgactgaatgggttttagatgttgcaattgagtttggaatcgatggtggttcgtttttcactcaagcttgtgttgtaaacagcttatattatcatgttcataagggtttgatttctttgccattgggtgaaactgtttcggttcctggatttccagtgcttcaacggtgggagacaccgttaattttgcagaatcatgagcaaatacagagcccttggtctcagatgttgtttggtcagtttgctaatattgatcaagcacgttgggtcttcacaaatagtttttacaagctcgaggaagaggtaatagagtggacgagaaagatatggaacttgaaggtaatcgggccaacacttccatccatgtaccttgacaaacgacttgatgatgataaagataacggatttaatctctacaaagcaaaccatcatgagtgcatgaactggttagacgataagccaaaggaatcagttgtttacgtagcatttggtagcctggtgaaacatggacccgaacaagtggaagaaatcacacgggctttaatagatagtgatgtcaacttcttgtgggttatcaaacataaagaagagggaaagctcccagaaaatctttcggaagtaataaaaaccggaaagggtttgattgtagcatggtgcaaacaattggatgtgttagcacacgaatcagtaggatgctttgttacacattgtgggttcaactcaactcttgaagcaataagtcttggagtccccgttgttgcaatgcctcaattttcggatcaaactacaaatgccaagcttctagatgaaattttgggtgttggagttagagttaaggctgatgagaatgggatagtgagaagaggaaatcttgcgtcatgtattaagatgattatggaggaggaaagaggagtaataatccgaaagaatgcggtaaaatggaaggatttggctaaagtagccgttcatgaaggtggtagctcagacaatgatattgtcgaatttgtaagtgagctaattaaggcttaaatttttgttgctttgtattttatgtgttatggttttttgatttagatgtattcaattaatattgaatcataactaaattcaagattattgtttgtaatattctttgtcctaaaattttgcgacttaaaacctttagtttataaaaagaaattagaaaatactattgcacgga

SEQ ID NO: 198 - protein, 460 aa, Stevia rebaudiana
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 199 - DNA, 1377 bp, Artificial Sequence
  Codon-optimized UGT76G1
atggaaaacaagaccgaaacaacagttagacgtaggcgtagaatcattctgtttccagtaccttttcaagggcacatcaatccaatactacaactagccaacgttttgtactctaaaggtttttctattacaatctttcacaccaatttcaacaaaccaaaaacatccaattacccacatttcacattcagattcatacttgataatgatccacaagatgaacgtatttcaaacttacctacccacggtcctttagctggaatgagaattccaatcatcaatgaacatggtgccgatgagcttagaagagaattagagttacttatgttggcatccgaagaggacgaggaagtctcttgtctgattactgacgctctatggtactttgcccaatctgtggctgatagtttgaatttgaggagattggtactaatgacatccagtctgtttaactttcacgctcatgttagtttaccacaatttgacgaattgggatacttggaccctgatgacaagactaggttagaggaacaggcctctggttttcctatgttgaaagtcaaagatatcaagtctgcctattctaattggcaaatcttgaaagagatcttaggaaagatgatcaaacagacaaaggcttcatctggagtgatttggaacagtttcaaagagttagaagagtctgaattggagactgtaatcagagaaattccagcaccttcattcctgataccattaccaaaacatttgactgcttcctcttcctctttgttggatcatgacagaacagtttttcaatggttggaccaacaaccacctagttctgttttgtacgtgtcatttggtagtacttctgaagtcgatgaaaaggacttccttgaaatcgcaagaggcttagtcgatagtaagcagtcattcctttgggtcgtgcgtccaggtttcgtgaaaggctcaacatgggtcgaaccacttccagatggttttctaggcgaaagaggtagaatagtcaaatgggttcctcaacaggaagttttagctcatggcgctattggggcattctggactcattccggatggaattcaactttagaatcagtatgcgaaggggtacctatgatcttttcagattttggtcttgatcaaccactgaacgcaagatacatgtctgatgttttgaaagtgggtgtatatctagaaaatggctgggaaaggggtgaaatagctaatgcaataagacgtgttatggttgatgaagagggggagtatatcagacaaaacgcaagagtgctgaagcaaaaggccgacgtttctctaatgaagggaggctcttcatacgaatccttagaatctcttgtttcctacatttcatcactgtaa

SEQ ID NO: 200 - protein, 458 aa, Stevia rebaudiana
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 201 - DNA, 1422 bp, Stevia rebaudiana
atggctacttctgattccatcgttgacgatagaaagcaattgcatgttgctacttttccatggttggctttcggtcatattttgccatacttgcaattgtccaagttgattgctgaaaagggtcacaaggtttcattcttgtctaccaccagaaacatccaaagattgtcctctcatatctccccattgatcaacgttgttcaattgactttgccaagagtccaagaattgccagaagatgctgaagctactactgatgttcatccagaagatatcccttacttgaaaaaggcttccgatggtttacaaccagaagttactagattcttggaacaacattccccagattggatcatctacgattatactcattactggttgccatccattgctgcttcattgggtatttctagagcccatttctctgttactactccatgggctattgcttatatgggtccatctgctgatgctatgattaacggttctgatggtagaactaccgttgaagatttgactactccaccaaagtggtttccatttccaacaaaagtctgttggagaaaacacgatttggctagattggttccatacaaagctccaggtatttctgatggttacagaatgggtatggttttgaaaggttccgattgcttgttgtctaagtgctatcatgaattcggtactcaatggttgcctttgttggaaacattgcatcaagttccagttgttccagtaggtttgttgccaccagaaattccaggtgacgaaaaagacgaaacttgggtttccatcaaaaagtggttggatggtaagcaaaagggttctgttgtttatgttgctttgggttccgaagctttggtttctcaaaccgaagttgttgaattggctttgggtttggaattgtctggtttgccatttgtttgggcttacagaaaacctaaaggtccagctaagtctgattctgttgaattgccagatggtttcgttgaaagaactagagatagaggtttggtttggacttcttgggctccacaattgagaattttgtctcatgaatccgtctgtggtttcttgactcattgtggttctggttctatcgttgaaggtttgatgtttggtcacccattgattatgttgccaatctttggtgaccaaccattgaacgctagattattggaagataagcaagtcggtatcgaaatcccaagaaatgaagaagatggttgcttgaccaaagaatctgttgctagatctttgagatccgttgtcgttgaaaaagaaggtgaaatctacaaggctaacgctagagaattgtccaagatctacaacgataccaaggtcgaaaaagaatacgtttcccaattcgttgactacttggaaaagaatgctagagctgttgccattgatcatgaatcttga

SEQ ID NO: 202 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGMVLKGSDCLLSKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 203 - DNA, 1389 bp, Artificial Sequence
  Codon-optimized EUGT11
atggatagtggctactcctcatcttatgctgctgccgctggtatgcacgttgtgatctgcccttggttggcctttggtcacctgttaccatgtctggatttagcccaaagactggcctcaagaggccatagagtatcatttgtgtctactcctagaaatatctctcgtttaccaccagtcagacctgctctagctcctctagttgcattcgttgctcttccacttccaagagtagaaggattgccagacggcgctgaatctactaatgacgtaccacatgatagacctgacatggtcgaattgcatagaagagcctttgatggattggcagctccattttctgagttcctgggcacagcatgtgcagactgggttatagtcgatgtatttcatcactgggctgctgcagccgcattggaacataaggtgccttgtgctatgatgttgttagggtcagcacacatgatcgcatccatagctgatagaagattggaaagagctgaaacagaatccccagccgcagcaggacaaggtaggccagctgccgccccaacctttgaagtggctagaatgaaattgattcgtactaaaggtagttcagggatgagtcttgctgaaaggttttctctgacattatctagatcatcattagttgtaggtagatcctgcgtcgagttcgaacctgaaacagtacctttactatctactttgagaggcaaacctattactttccttggtctaatgcctccattacatgaaggaaggagagaagatggtgaagatgctactgttaggtggttagatgcccaacctgctaagtctgttgtttacgttgcattgggttctgaggtaccactaggggtggaaaaggtgcatgaattagcattaggacttgagctggccggaacaagattcctttgggctttgagaaaaccaaccggtgtttctgacgccgacttgctaccagctgggttcgaagagagaacaagaggccgtggtgtcgttgctactagatgggtcccacaaatgagtattctagctcatgcagctgtaggggcctttctaacccattgcggttggaactcaacaatagaaggactgatgtttggtcatccacttattatgttaccaatctttggcgatcagggacctaacgcaagattgattgaggcaaagaacgcaggtctgcaggttgcacgtaatgatggtgatggttcctttgatagagaaggcgttgcagctgccatcagagcagtcgccgttgaggaagagtcatctaaagttttccaagctaaggccaaaaaattacaagagattgtggctgacatggcttgtcacgaaagatacatcgatggtttcatccaacaattgagaagttataaagactaa

SEQ ID NO: 204 - protein, 462 aa, Oryza sativa
MDSGYSSSYAAAAGMHVVICPWLAFGHLLPCLDLAQRLASRGHRVSFVSTPRNISRLPPVRPALAPLVAFVALPLPRVEGLPDGAESTNDVPHDRPDMVELHRRAFDGLAAPFSEFLGTACADWVIVDVFHHWAAAAALEHKVPCAMMLLGSAHMIASIADRRLERAETESPAAAGQGRPAAAPTFEVARMKLIRTKGSSGMSLAERFSLTLSRSSLVVGRSCVEFEPETVPLLSTLRGKPITFLGLMPPLHEGRREDGEDATVRWLDAQPAKSVVYVALGSEVPLGVEKVHELALGLELAGTRFLWALRKPTGVSDADLLPAGFEERTRGRGVVATRWVPQMSILAHAAVGAFLTHCGWNSTIEGLMFGHPLIMLPIFGDQGPNARLIEAKNAGLQVARNDGDGSFDREGVAAAIRAVAVEEESSKVFQAKAKKLQEIVADMACHERYIDGFIQQLRSYKD

SEQ ID NO: 205 - DNA, 1536 bp, Artificial Sequence
  Codon-optimized KO
atggctaccttgttggaacattttcaagctatgccattcgctattccaattgctttggctgctttgtcttggttgtttttgttctacatcaaggtttctttcttctccaacaaatccgctcaagctaaattgccaccagttccagttgttccaggtttgccagttattggtaatttgttgcaattgaaagaaaagaagccataccaaaccttcactagatgggctgaagaatatggtccaatctactctattagaactggtgcttctactatggttgtcttgaacactactcaagttgccaaagaagctatggttaccagatacttgtctatctctaccagaaagttgtccaacgccttgaaaattttgaccgctgataagtgcatggttgccatttctgattacaacgatttccacaagatgatcaagagatatatcttgtctaacgttttgggtccatctgcccaaaaaagacatagatctaacagagataccttgagagccaacgtttgttctagattgcattcccaagttaagaactctccaagagaagctgtcaactttagaagagttttcgaatgggaattattcggtatcgctttgaaacaagccttcggtaaggatattgaaaagccaatctacgtcgaagaattgggtactactttgtccagagatgaaatcttcaaggttttggtcttggacattatggaaggtgccattgaagttgattggagagattttttcccatacttgcgttggattccaaacaccagaatggaaactaagatccaaagattatactttagaagaaaggccgttatgaccgccttgattaacgaacaaaagaaaagaattgcctccggtgaagaaatcaactgctacatcgatttcttgttgaaagaaggtaagaccttgaccatggaccaaatctctatgttgttgtgggaaaccgttattgaaactgctgataccacaatggttactactgaatgggctatgtacgaagttgctaaggattctaaaagacaagacagattataccaagaaatccaaaaggtctgcggttctgaaatggttacagaagaatacttgtcccaattgccatacttgaatgctgttttccacgaaactttgagaaaacattctccagctgctttggttccattgagatatgctcatgaagatactcaattgggtggttattacattccagccggtactgaaattgccattaacatctacggttgcaacatggacaaacaccaatgggaatctccagaagaatggaagccagaaagatttttggatcctaagtttgacccaatggacttgtacaaaactatggcttttggtgctggtaaaagagtttgcgctggttctttacaagctatgttgattgcttgtccaaccatcggtagattggttcaagaatttgaatggaagttgagagatggtgaagaagaaaacgttgatactgttggtttgaccacccataagagatatccaatgcatgctattttgaagccaagatcttaa

SEQ ID NO: 206 - protein, 511 aa, Rubus suavissimus
MATLLEHFQAMPFAIPIALAALSWLFLFYIKVSFFSNKSAQAKLPPVPVVPGLPVIGNLLQLKEKKPYQTFTRWAEEYGPIYSIRTGASTMVVLNTTQVAKEAMVTRYLSISTRKLSNALKILTADKCMVAISDYNDFHKMIKRYILSNVLGPSAQKRHRSNRDTLRANVCSRLHSQVKNSPREAVNFRRVFEWELFGIALKQAFGKDIEKPIYVEELGTTLSRDEIFKVLVLDIMEGAIEVDWRDFFPYLRWIPNTRMETKIQRLYFRRKAVMTALINEQKKRIASGEEINCYIDFLLKEGKTLTMDQISMLLWETVIETADTTMVTTEWAMYEVAKDSKRQDRLYQEIQKVCGSEMVTEEYLSQLPYLNAVFHETLRKHSPAALVPLRYAHEDTQLGGYYIPAGTEIAINIYGCNMDKHQWESPEEWKPERFLDPKFDPMDLYKTMAFGAGKRVCAGSLQAMLIACPTIGRLVQEFEWKLRDGEEENVDTVGLTTHKRYPMHAILKPRS

SEQ ID NO: 207 - DNA, 1086 bp, Artificial Sequence
  Codon-optimized GGPPS
atggctttggtaaacccaaccgctcttttctatggtacctctatcagaacaagacctacaaacttactaaatccaactcaaaagctaagaccagtttcatcatcttccttaccttctttctcatcagttagtgcgattcttactgaaaaacatcaatctaatccttctgagaacaacaatttgcaaactcatctagaaactcctttcaactttgatagttatatgttggaaaaagtcaacatggttaacgaggcgcttgatgcatctgtcccactaaaagacccaatcaaaatccatgaatccatgagatactctttattggcaggcggtaagagaatcagaccaatgatgtgtattgcagcctgcgaaatagtcggaggtaatatccttaacgccatgccagccgcatgtgccgtggaaatgattcatactatgtctttggtgcatgacgatcttccatgtatggataatgatgacttcagaagaggtaaacctatttcacacaaggtctacggggaggaaatggcagtattgaccggcgatgctttactaagtttatctttcgaacatatagctactgctacaaagggtgtatcaaaggatagaatcgtcagagctataggggagttggcccgttcagttggctccgaaggtttagtggctggacaagttgtagatatcttgtcagagggtgctgatgttggattagatcacctagaatacattcacatccacaaaacagcaatgttgcttgagtcctcagtagttattggcgctatcatgggaggaggatctgatcagcagatcgaaaagttgagaaaattcgctagatctattggtctactattccaagttgtggatgacattttggatgttacaaaatctaccgaagagttggggaaaacagctggtaaggatttgttgacagataagacaacttacccaaagttgttaggtatagaaaagtccagagaatttgccgaaaaacttaacaaggaagcacaagagcaattaagtggctttgatagacgtaaggcagctcctttgatcgcgttagccaactacaatgcgtaccgtcaaaattga

SEQ ID NO: 208 - protein, 361 aa, Stevia rebaudiana
MALVNPTALFYGTSIRTRPTNLLNPTQKLRPVSSSSLPSFSSVSAILTEKHQSNPSENNNLQTHLETPFNFDSYMLEKVNMVNEALDASVPLKDPIKIHESMRYSLLAGGKRIRPMMCIAACEIVGGNILNAMPAACAVEMIHTMSLVHDDLPCMDNDDFRRGKPISHKVYGEEMAVLTGDALLSLSFEHIATATKGVSKDRIVRAIGELARSVGSEGLVAGQVVDILSEGADVGLDHLEYIHIHKTAMLLESSVVIGAIMGGGSDQQIEKLRKFARSIGLLFQVVDDILDVTKSTEELGKTAGKDLLTDKTTYPKLLGIEKSREFAEKLNKEAQEQLSGFDRRKAAPLIALANYNAYRQN

SEQ ID NO: 209 - DNA, 1029 bp, Artificial Sequence
  Codon-optimized GGPPS
atggctgagcaacaaatatctaacttgctgtctatgtttgatgcttcacatgctagtcagaaattagaaattactgtccaaatgatggacacataccattacagagaaacgcctccagattcctcatcttctgaaggcggttcattgtctagatacgacgagagaagagtctctttgcctctcagtcataatgctgcctctccagatattgtatcacaactatgtttttccactgcaatgtcttcagagttgaatcacagatggaaatctcaaagattaaaggtggccgattctccttacaactatatcctaacattaccatcaaaaggaattagaggtgcctttatcgattccctgaacgtatggttggaggttccagaggatgaaacatcagtcatcaaggaagttattggtatgctccacaactcttcattaatcattgatgacttccaagataattctccacttagaagaggaaagccatctacccatacagtcttcggccctgcccaggctatcaatactgctacttacgttatagttaaagcaatcgaaaagatacaagacatagtgggacacgatgcattggcagatgttacgggtactattacaactattttccaaggtcaggccatggacttgtggtggacagcaaatgcaatcgttccatcaatacaggaatacttacttatggtaaacgataaaaccggtgctctctttagactgagtttggagttgttagctctgaattccgaagccagtatttctgactctgctttagaaagtttatctagtgctgtttccttgctaggtcaatacttccaaatcagagacgactatatgaacttgatcgataacaagtatacagatcagaaaggcttctgcgaagatcttgatgaaggcaagtactcactaacacttattcatgccctccaaactgattcatccgatctactgaccaacatcctttcaatgagaagagtgcaaggaaagttaacggcacaaaagagatgttggttctggaaatga

SEQ ID NO: 210 - protein, 342 aa, Gibberella fujikuroi
MAEQQISNLLSMFDASHASQKLEITVQMMDTYHYRETPPDSSSSEGGSLSRYDERRVSLPLSHNAASPDIVSQLCFSTAMSSELNHRWKSQRLKVADSPYNYILTLPSKGIRGAFIDSLNVWLEVPEDETSVIKEVIGMLHNSSLIIDDFQDNSPLRRGKPSTHTVFGPAQAINTATYVIVKAIEKIQDIVGHDALADVTGTITTIFQGQAMDLWWTANAIVPSIQEYLLMVNDKTGALFRLSLELLALNSEASISDSALESLSSAVSLLGQYFQIRDDYMNLIDNKYTDQKGFCEDLDEGKYSLTLIHALQTDSSDLLTNILSMRRVQGKLTAQKRCWFWK

SEQ ID NO: 211 - DNA, 903 bp, Artificial Sequence
  Codon-optimized GGPPS
atggaaaagactaaggagaaagcagaacgtatcttgctggagccatacagatacttattacaactaccaggaaagcaagtccgttctaaactatcacaagcgttcaatcactggttaaaagttcctgaagataagttacaaatcattattgaagtcacagaaatgctacacaatgcttctttactgatcgatgatatagaggattcttccaaactgagaagaggttttcctgtcgctcattccatatacggggtaccaagtgtaatcaactcagctaattacgtctacttcttgggattggaaaaagtattgacattagatcatccagacgctgtaaagctattcaccagacaacttcttgaattgcatcaaggtcaaggtttggatatctattggagagacacttatacttgcccaacagaagaggagtacaaagcaatggttctacaaaagactggcggtttgttcggacttgccgttggtctgatgcaacttttctctgattacaaggaggacttaaagcctctgttggataccttgggcttgtttttccagattagagatgactacgctaacttacattcaaaggaatattcagaaaacaaatcattctgtgaagatttgactgaagggaagtttagttttccaacaatccacgccatttggtcaagaccagaatctactcaagtgcaaaacattctgcgtcagagaacagagaatattgacatcaaaaagtattgtgttcagtacttggaagatgttggttcttttgcttacacaagacatacacttagagaattagaggcaaaagcatacaagcaaatagaagcctgtggaggcaatccttctctagtggcattggttaaacatttgtccaaaatgttcaccgaggaaaacaagtaa

SEQ ID NO: 212 - protein, 300 aa, Mus musculus
MEKTKEKAERILLEPYRYLLQLPGKQVRSKLSQAFNHWLKVPEDKLQIIIEVTEMLHNASLLIDDIEDSSKLRRGFPVAHSIYGVPSVINSANYVYFLGLEKVLTLDHPDAVKLFTRQLLELHQGQGLDIYWRDTYTCPTEEEYKAMVLQKTGGLFGLAVGLMQLFSDYKEDLKPLLDTLGLFFQIRDDYANLHSKEYSENKSFCEDLTEGKFSFPTIHAIWSRPESTQVQNILRQRTENIDIKKYCVQYLEDVGSFAYTRHTLRELEAKAYKQIEACGGNPSLVALVKHLSKMFTEENK

SEQ ID NO: 213 - DNA, 1020 bp, Artificial Sequence
  Codon-optimized GGPPS
atggcaagattctattttcttaacgcactattgatggttatctcattacaatcaactacagccttcactccagctaaacttgcttatccaacaacaacaacagctctaaatgtcgcctccgccgaaacttctttcagtctagatgaatacttggcctctaagataggacctatagagtctgccttggaagcatcagtcaaatccagaattccacagaccgataagatctgcgaatctatggcctactctttgatggcaggaggcaagagaattagaccagtgttgtgtatcgctgcatgtgagatgttcggtggatcccaagatgtcgctatgcctactgctgtggcattagaaatgatacacacaatgtctttgattcatgatgatttgccatccatggataacgatgacttgagaagaggtaaaccaacaaaccatgtcgttttcggcgaagatgtagctattcttgcaggtgactctttattgtcaacttccttcgagcacgtcgctagagaaacaaaaggagtgtcagcagaaaagatcgtggatgttatcgctagattaggcaaatctgttggtgccgagggccttgctggcggtcaagttatggacttagaatgtgaagctaaaccaggtaccacattagacgacttgaaatggattcatatccataaaaccgctacattgttacaagttgctgtagcttctggtgcagttctaggtggtgcaactcctgaagaggttgctgcatgcgagttgtttgctatgaatataggtcttgcctttcaagttgccgacgatatccttgatgtaaccgcttcatcagaagatttgggtaaaactgcaggcaaagatgaagctactgataagacaacttacccaaagttattaggattagaagagagtaaggcatacgcaagacaactaatcgatgaagccaaggaaagtttggctccttttggagatagagctgcccctttattggccattgcagatttcattattgatagaaagaattga

SEQ ID NO: 214 - protein, 339 aa, Thalassiosira pseudonana
MARFYFLNALLMVISLQSTTAFTPAKLAYPTTTTALNVASAETSFSLDEYLASKIGPIESALEASVKSRIPQTDKICESMAYSLMAGGKRIRPVLCIAACEMFGGSQDVAMPTAVALEMIHTMSLIHDDLPSMDNDDLRRGKPTNHVVFGEDVAILAGDSLLSTSFEHVARETKGVSAEKIVDVIARLGKSVGAEGLAGGQVMDLECEAKPGTTLDDLKWIHIHKTATLLQVAVASGAVLGGATPEEVAACELFAMNIGLAFQVADDILDVTASSEDLGKTAGKDEATDKTTYPKLLGLEESKAYARQLIDEAKESLAPFGDRAAPLLAIADFIIDRKN

SEQ ID NO: 215 - DNA, 1068 bp, Artificial Sequence
  Codon-optimized GGPPS
atgcacttagcaccacgtagagtccctagaggtagaagatcaccacctgacagagttcctgaaagacaaggtgccttgggtagaagacgtggagctggctctactggctgtgcccgtgctgctgctggtgttcaccgtagaagaggaggaggcgaggctgatccatcagctgctgtgcatagaggctggcaagccggtggtggcaccggtttgcctgatgaggtggtgtctaccgcagccgccttagaaatgtttcatgcttttgctttaatccatgatgatatcatggatgatagtgcaactagaagaggctccccaactgttcacagagccctagctgatcgtttaggcgctgctctggacccagatcaggccggtcaactaggagtttctactgctatcttggttggagatctggctttgacatggtccgatgaattgttatacgctccattgactccacatagactggcagcagtactaccattggtaacagctatgagagctgaaaccgttcatggccaatatcttgatataactagtgctagaagacctgggaccgatacttctcttgcattgagaatagccagatataagacagcagcttacacaatggaacgtccactgcacattggtgcagccctggctggggcaagaccagaactattagcagggctttcagcatacgccttgccagctggagaagccttccaattggcagatgacctgctaggcgtcttcggtgatccaagacgtacagggaaacctgacctagatgatcttagaggtggaaagcatactgtcttagtcgccttggcaagagaacatgccactccagaacagagacacacattggatacattattgggtacaccaggtcttgatagacaaggcgcttcaagactaagatgcgtattggtagcaactggtgcaagagccgaagccgaaagacttattacagagagaagagatcaagcattaactgcattgaacgcattaacactgccacctcctttagctgaggcattagcaagattgacattagggtctacagctcatcctgcctaa

SEQ ID NO: 216 - protein, 355 aa, Streptomyces clavuligerus
MHLAPRRVPRGRRSPPDRVPERQGALGRRRGAGSTGCARAAAGVHRRRGGGEADPSAAVHRGWQAGGGTGLPDEVVSTAAALEMFHAFALIHDDIMDDSATRRGSPTVHRALADRLGAALDPDQAGQLGVSTAILVGDLALTWSDELLYAPLTPHRLAAVLPLVTAMRAETVHGQYLDITSARRPGTDTSLALRIARYKTAAYTMERPLHIGAALAGARPELLAGLSAYALPAGEAFQLADDLLGVFGDPRRTGKPDLDDLRGGKHTVLVALAREHATPEQRHTLDTLLGTPGLDRQGASRLRCVLVATGARAEAERLITERRDQALTALNALTLPPPLAEALARLTLGSTAHPA

SEQ ID NO: 217 - DNA, 993 bp, Artificial Sequence
  Codon-optimized GGPPS
atgtcatatttcgataactacttcaatgagatagttaattccgtgaacgacatcattaagtcttacatctctggcgacgtaccaaaactatacgaagcctcctaccatttgtttacatcaggaggaaagagactaagaccattgatccttacaatttcttctgatcttttcggtggacagagagaaagagcatactatgctggcgcagcaatcgaagttttgcacacattcactttggttcacgatgatatcatggatcaagataacattcgtagaggtcttcctactgtacatgtcaagtatggcctacctttggccattttagctggtgacttattgcatgcaaaagcctttcaattgttgactcaggcattgagaggtctaccatctgaaactatcatcaaggcgtttgatatctttacaagatctatcattatcatatcagaaggtcaagctgtcgatatggaattcgaagatagaattgatatcaaggaacaagagtatttggatatgatatctcgtaaaaccgctgccttattctcagcttcttcttccattggggcgttgatagctggagctaatgataacgatgtgagattaatgtccgatttcggtacaaatcttgggatcgcatttcaaattgtagatgatatacttggtttaacagctgatgaaaaagagctaggaaaacctgttttcagtgatatcagagaaggtaaaaagaccatattagtcattaagactttagaattgtgtaaggaagacgagaaaaagattgtgttaaaagcgctaggcaacaagtcagcatcaaaggaagagttgatgagttctgctgacataatcaaaaagtactcattggattacgcctacaacttagctgagaaatactacaaaaacgccatcgattctctaaatcaagtttcaagtaaaagtgatattccagggaaggcattgaaatatcttgctgaattcaccatcagaagacgtaagtaa

SEQ ID NO: 218 - protein, 330 aa, Sulfolobus acidocaldarius
MSYFDNYFNEIVNSVNDIIKSYISGDVPKLYEASYHLFTSGGKRLRPLILTISSDLFGGQRERAYYAGAAIEVLHTFTLVHDDIMDQDNIRRGLPTVHVKYGLPLAILAGDLLHAKAFQLLTQALRGLPSETIIKAFDIFTRSIIIISEGQAVDMEFEDRIDIKEQEYLDMISRKTAALFSASSSIGALIAGANDNDVRLMSDFGTNLGIAFQIVDDILGLTADEKELGKPVFSDIREGKKTILVIKTLELCKEDEKKIVLKALGNKSASKEELMSSADIIKKYSLDYAYNLAEKYYKNAIDSLNQVSSKSDIPGKALKYLAEFTIRRRK

SEQ ID NO: 219 - DNA, 1116 bp, Artificial Sequence
  Codon-optimized GGPPS
atggcctctgttactttgggttcctggatcgtcgtccaccaccataaccatcaccatccatcatctatcctaactaaatctcgttcaagatcctgtcctattacactaaccaaaccaatctcttttcgttcaaagagaacagtttcctctagtagttctatcgtgtcctctagtgtcgtcactaaggaagacaatctgagacagtctgaaccttcttcctttgatttcatgtcatatatcattactaaggcagaactagtgaataaggctcttgattcagcagttccattaagagagccattgaaaatccatgaagcaatgagatactctcttctagctggcgggaagagagtcagacctgtactctgcatagcagcgtgcgaattagttggtggcgaggaatcaaccgctatgcctgccgcttgtgctgtagaaatgattcatacaatgtcactgatacacgatgatttgccatgtatggataacgatgatctgagaaggggtaagccaactaaccataaggttttcggcgaagatgttgccgtcttagctggtgatgctttgttatctttcgcgttcgaacatttggcatccgcaacatcaagtgatgttgtgtcaccagtaagagtagttagagcagttggagaactggctaaagctattggaactgagggtttagttgcaggtcaagtcgtcgatatctcttccgaaggtcttgatttgaatgatgtaggtcttgaacatctcgaattcatccatcttcacaagacagctgcacttttagaagccagtgcggttctcggcgcaattgttggcggagggagtgatgacgaaattgagagattgaggaagtttgctagatgtataggattactgttccaagtagtagacgatatactagatgtgacaaagtcttccaaagagttgggaaaaacagctggtaaagatttgattgccgacaaattgacctaccctaagattatggggctagaaaaatcaagagaatttgccgagaaactcaatagagaggcgcgtgatcaactgttgggtttcgattctgataaagttgcaccactcttagccttagccaactacatcgcttacagacaaaactaa

SEQ ID NO: 220 - protein, 371 aa, Arabidopsis thaliana
MASVTLGSWIVVHHHNHHHPSSILTKSRSRSCPITLTKPISFRSKRTVSSSSSIVSSSVVTKEDNLRQSEPSSFDFMSYIITKAELVNKALDSAVPLREPLKIHEAMRYSLLAGGKRVRPVLCIAACELVGGEESTAMPAACAVEMIHTMSLIHDDLPCMDNDDLRRGKPTNHKVFGEDVAVLAGDALLSFAFEHLASATSSDVVSPVRVVRAVGELAKAIGTEGLVAGQVVDISSEGLDLNDVGLEHLEFIHLHKTAALLEASAVLGAIVGGGSDDEIERLRKFARCIGLLFQVVDDILDVTKSSKELGKTAGKDLIADKLTYPKIMGLEKSREFAEKLNREARDQLLGFDSDKVAPLLALANYIAYRQN

SEQ ID NO: 221 - DNA, 2364 bp, Artificial Sequence
  Codon-optimized CDPS
atgaaaaccgggtttatctcaccagcaacagtatttcatcacagaatctcaccagcgaccactttcagacatcacttatcacctgctactacaaactctacaggcattgtcgccttaagagacatcaacttcagatgtaaagcagtttctaaagagtactctgatctgttgcagaaagatgaggcttctttcacaaaatgggacgatgacaaggtgaaagatcatcttgataccaacaaaaacttatacccaaatgatgagattaaggaatttgttgaatcagtaaaggctatgttcggtagtatgaatgacggggagataaacgtctctgcatacgatactgcatgggttgctttggttcaagatgtcgatggatcaggtagtcctcagttcccttcttctttagaatggattgccaacaatcaattgtcagatggatcatggggagatcatttgctgttctcagctcacgatagaatcatcaacacattagcatgcgttattgcacttacaagttggaatgttcatccttctaagtgtgaaaaaggtttgaattttctgagagaaaacatttgcaaattagaagatgaaaacgcagaacatatgccaattggttttgaagtaacattcccatcactaattgatatcgcgaaaaagttgaacattgaagtacctgaggatactccagcacttaaagagatctacgcacgtagagatatcaagttaactaagatcccaatggaagttcttcacaaggtacctactactttgttacattctttggaaggaatgcctgatttggagtgggaaaaactgttaaagctacaatgtaaagatggtagtttcttgttttccccatctagtaccgcattcgccctaatgcaaacaaaagatgagaaatgcttacagtatctaacaaatatcgtcactaagttcaacggtggcgtgcctaatgtgtacccagtcgatttgtttgaacatatttgggttgttgatagactgcagagattggggattgccagatacttcaaatcagagataaaagattgtgtagagtatatcaataagtactggaccaaaaatggaatttgttgggctagaaatactcacgttcaagatatcgatgatacagccatgggattcagagtgttgagagcgcacggttatgacgtcactccagatgtttttagacaatttgaaaaagatggtaaattcgtttgctttgcagggcaatcaacacaagccgtgacaggaatgtttaacgtttacagagcctctcaaatgttgttcccaggggagagaattttggaagatgccaaaaagttctcttacaattacttaaaggaaaagcaaagtaccaacgaattgctggataaatggataatcgctaaagatctacctggtgaagttggttatgctctggatatcccatggtatgcttccttaccaagattggaaactcgttattaccttgaacaatacggcggtgaagatgatgtctggataggcaagacattatacagaatgggttacgtgtccaataacacatatctagaaatggcaaagctggattacaataactatgttgcagtccttcaattagaatggtacacaatacaacaatggtacgtcgatattggtatagagaagttcgaatctgacaacatcaagtcagtcctggtttcttactacttggctgcggcttcaatattcgaacctgagagatctaaggagagaatcgcttgggcaaagacaacaatcttagtcgataagatcacatcaattttcgattcctctcagtcaagtaaggaagatattactgcctttattgacaagtttcgtaacaagtcctcctctaaaaagcactctatcaacggtgaaccatggcatgaagttatggtagctttgaaaaagaccttacacggctttgctctggatgctcttatgactcattctcaagatatacatccacagttacatcaagcctgggaaatgtggttgactaaactacaagacggcgtagatgttactgctgagctaatggtccaaatgatcaacatgactgctggcagatgggtatcaaaggaattacttactcatccacaatatcaaagattgtctactgtgacaaattctgtgtgtcacgatattaccaaacttcacaatttcaaggagaattccaccacagtggattcaaaggttcaggaactagtccagttggtttttagtgacacaccagatgatttggatcaagatatgaaacaaacattcctgacagtgatgaagacattctactacaaggcgtggtgtgatccaaacactataaacgatcatatatctaaagttttcgaaatcgtaatttga

SEQ ID NO: 222 - protein, 787 aa, Stevia rebaudiana
MKTGFISPATVFHHRISPATTFRHHLSPATTNSTGIVALRDINFRCKAVSKEYSDLLQKDEASFTKWDDDKVKDHLDTNKNLYPNDEIKEFVESVKAMFGSMNDGEINVSAYDTAWVALVQDVDGSGSPQFPSSLEWIANNQLSDGSWGDHLLFSAHDRIINTLACVIALTSWNVHPSKCEKGLNFLRENICKLEDENAEHMPIGFEVTFPSLIDIAKKLNIEVPEDTPALKEIYARRDIKLTKIPMEVLHKVPTTLLHSLEGMPDLEWEKLLKLQCKDGSFLFSPSSTAFALMQTKDEKCLQYLTNIVTKFNGGVPNVYPVDLFEHIWVVDRLQRLGIARYFKSEIKDCVEYINKYWTKNGICWARNTHVQDIDDTAMGFRVLRAHGYDVTPDVFRQFEKDGKFVCFAGQSTQAVTGMFNVYRASQMLFPGERILEDAKKFSYNYLKEKQSTNELLDKWIIAKDLPGEVGYALDIPWYASLPRLETRYYLEQYGGEDDVWIGKTLYRMGYVSNNTYLEMAKLDYNNYVAVLQLEWYTIQQWYVDIGIEKFESDNIKSVLVSYYLAAASIFEPERSKERIAWAKTTILVDKITSIFDSSQSSKEDITAFIDKFRNKSSSKKHSINGEPWHEVMVALKKTLHGFALDALMTHSQDIHPQLHQAWEMWLTKLQDGVDVTAELMVQMINMTAGRWVSKELLTHPQYQRLSTVTNSVCHDITKLHNFKENSTTVDSKVQELVQLVFSDTPDDLDQDMKQTFLTVMKTFYYKAWCDPNTINDHISKVFEIVI

SEQ ID NO: 223 - DNA, 1584 bp, Artificial Sequence
  Codon-optimized CDPS
atgcctgatgcacacgatgctccacctccacaaataagacagagaacactagtagatgaggctacccaactgctaactgagtccgcagaagatgcatggggtgaagtcagtgtgtcagaatacgaaacagcaaggctagttgcccatgctacatggttaggtggacacgccacaagagtggccttccttctggagagacaacacgaagacgggtcatggggtccaccaggtggatataggttagtccctacattatctgctgttcacgcattattgacatgtcttgcctctcctgctcaggatcatggcgttccacatgatagacttttaagagctgttgacgcaggcttgactgccttgagaagattggggacatctgactccccacctgatactatagcagttgagctggttatcccatctttgctagagggcattcaacacttactggaccctgctcatcctcatagtagaccagccttctctcaacatagaggctctcttgtttgtcctggtggactagatgggagaactctaggagctttgagatcacacgccgcagcaggtacaccagtaccaggaaaagtctggcacgcttccgagactttgggcttgagtaccgaagctgcttctcacttgcaaccagcccaaggtataatcggtggctctgctgctgccacagcaacatggctaaccagggttgcaccatctcaacagtcagattctgccagaagataccttgaggaattacaacacagatactctggcccagttccttccattacccctatcacatacttcgaaagagcatggttattgaacaattttgcagcagccggtgttccttgtgaggctccagctgctttgttggattccttagaagcagcacttacaccacaaggtgctcctgctggagcaggattgcctccagatgctgatgatacagccgctgtgttgcttgcattggcaacacatgggagaggtagaagaccagaagtactgatggattacaggactgacgggtatttccaatgctttattggggaaaggactccatcaatttcaacaaacgctcacgtattggaaacattagggcatcatgtggcccaacatccacaagatagagccagatacggatcagccatggataccgcatcagcttggctgctggcagctcaaaagcaagatggctcttggttagataaatggcatgcctcaccatactacgctactgtttgttgcacacaagccctagccgctcatgcaagtcctgcaactgcaccagctagacagagagctgtcagatgggttttagccacacaaagatccgatggcggttggggtctatggcattcaactgttgaagagactgcttatgccttacagatcttggccccaccttctggtggtggcaatatcccagtccaacaagcacttactagaggcagagcaagattgtgtggagccttgccactgactcctttatggcatgataaggatttgtatactccagtaagagtagtcagagctgccagagctgctgctctgtacactaccagagatctattgttaccaccattgtaa

SEQ ID NO: 224 - protein, 527 aa, Streptomyces clavuligerus
MPDAHDAPPPQIRQRTLVDEATQLLTESAEDAWGEVSVSEYETARLVAHATWLGGHATRVAFLLERQHEDGSWGPPGGYRLVPTLSAVHALLTCLASPAQDHGVPHDRLLRAVDAGLTALRRLGTSDSPPDTIAVELVIPSLLEGIQHLLDPAHPHSRPAFSQHRGSLVCPGGLDGRTLGALRSHAAAGTPVPGKVWHASETLGLSTEAASHLQPAQGIIGGSAAATATWLTRVAPSQQSDSARRYLEELQHRYSGPVPSITPITYFERAWLLNNFAAAGVPCEAPAALLDSLEAALTPQGAPAGAGLPPDADDTAAVLLALATHGRGRRPEVLMDYRTDGYFQCFIGERTPSISTNAHVLETLGHHVAQHPQDRARYGSAMDTASAWLLAAQKQDGSWLDKWHASPYYATVCCTQALAAHASPATAPARQRAVRWVLATQRSDGGWGLWHSTVEETAYALQILAPPSGGGNIPVQQALTRGRARLCGALPLTPLWHDKDLYTPVRVVRAARAAALYTTRDLLLPPL

SEQ ID NO: 225 - DNA, 1551 bp, Streptomyces clavuligerus
atgaacgccctatccgaacacattttgtctgaattgagaagattattgtctgaaatgagtgatggcggatctgttggtccatctgtgtatgatacggcccaggccctaagattccacggtaacgtaacaggtagacaagatgcatatgcttggttgatcgcccagcaacaagcagatggaggttggggctctgccgactttccactctttagacatgctccaacatgggctgcacttctcgcattacaaagagctgatccacttcctggcgcagcagacgcagttcagaccgcaacaagattcttgcaaagacaaccagatccatacgctcatgccgttcctgaggatgcccctattggtgctgaactgatcttgcctcagttttgtggagaggctgcttggttgttgggaggtgtggccttccctagacacccagccctattaccattaagacaggcttgtttagtcaaactgggtgcagtcgccatgttgccttcaggacacccattgctccactcctgggaggcatggggtacttctccaacaacagcctgtccagacgatgatggttctataggtatctcaccagcagctacagccgcctggagagcccaggctgtgaccagaggctcaactcctcaagtgggcagagctgacgcatacttacaaatggcttcaagagcaacgagatcaggcatagaaggagtcttccctaatgtttggcctataaacgtattcgaaccatgctggtcactgtacactctccatcttgccggtctgttcgcccatccagcactggctgaggctgtaagagttatcgttgctcaacttgaagcaagattgggagtgcatggcctcggaccagctttacattttgctgccgacgctgatgatactgcagttgccttatgcgttctgcatttggctggcagagatcctgcagttgacgcattgagacattttgaaattggtgagctctttgttacattcccaggagagagaaatgctagtgtctctacgaacattcacgctcttcatgctttgagattgttaggtaaaccagctgccggagcaagtgcatacgtcgaagcaaatagaaatccacatggtttgtgggacaacgaaaaatggcacgtttcatggctttatccaactgcacacgccgttgcagctctagctcaaggcaagcctcaatggagagatgaaagagcactagccgctctactacaagctcaaagagatgatggtggttggggagctggtagaggatccactttcgaggaaaccgcctacgctcttttcgctttacacgttatggacggatctgaggaagccacaggcagaagaagaatcgctcaagtcgtcgcaagagccttagaatggatgctagctagacatgccgcacatggattaccacaaacaccactctggattggtaaggaattgtactgtcctactagagtcgtaagagtagctgagctagctggcctgtggttagcattaagatggggtagaagagtattagctgaaggtgctggtgctgcaccttaa

SEQ ID NO: 226 - protein, 516 aa, Bradyrhizobium japonicum
MNALSEHILSELRRLLSEMSDGGSVGPSVYDTAQALRFHGNVTGRQDAYAWLIAQQQADGGWGSADFPLFRHAPTWAALLALQRADPLPGAADAVQTATRFLQRQPDPYAHAVPEDAPIGAELILPQFCGEAAWLLGGVAFPRHPALLPLRQACLVKLGAVAMLPSGHPLLHSWEAWGTSPTTACPDDDGSIGISPAATAAWRAQAVTRGSTPQVGRADAYLQMASRATRSGIEGVFPNVWPINVFEPCWSLYTLHLAGLFAHPALAEAVRVIVAQLEARLGVHGLGPALHFAADADDTAVALCVLHLAGRDPAVDALRHFEIGELFVTFPGERNASVSTNIHALHALRLLGKPAAGASAYVEANRNPHGLWDNEKWHVSWLYPTAHAVAALAQGKPQWRDERALAALLQAQRDDGGWGAGRGSTFEETAYALFALHVMDGSEEATGRRRIAQVVARALEWMLARHAAHGLPQTPLWIGKELYCPTRVVRVAELAGLWLALRWGRRVLAEGAGAAP

SEQ ID NO: 227 - DNA, 2490 bp, Artificial Sequence
  Codon-optimized CDPS
atggttttgtcttcttcttgtactacagtaccacacttatcttcattagctgtcgtgcaacttggtccttggagcagtaggattaaaaagaaaaccgatactgttgcagtaccagccgctgcaggaaggtggagaagggccttggctagagcacagcacacatcagaatccgcagctgtcgcaaagggcagcagtttgacccctatagtgagaactgacgctgagtcaaggagaacaagatggccaaccgatgacgatgacgccgaacctttagtggatgagatcagggcaatgcttacttccatgtctgatggtgacatttccgtgagcgcatacgatacagcctgggtcggattggttccaagattagacggcggtgaaggtcctcaatttccagcagctgtgagatggataagaaataaccagttgcctgacggaagttggggcgatgccgcattattctctgcctatgacaggcttatcaatacccttgcctgcgttgtaactttgacaaggtggtccctagaaccagagatgagaggtagaggactatcttttttgggtaggaacatgtggaaattagcaactgaagatgaagagtcaatgcctattggcttcgaattagcatttccatctttgatagagcttgctaagagcctaggtgtccatgacttcccttatgatcaccaggccctacaaggaatctactcttcaagagagatcaaaatgaagaggattccaaaagaagtgatgcataccgttccaacatcaatattgcacagtttggagggtatgcctggcctagattgggctaaactacttaaactacagagcagcgacggaagttttttgttctcaccagctgccactgcatatgctttaatgaataccggagatgacaggtgttttagctacatcgatagaacagtaaagaaattcaacggcggcgtccctaatgtttatccagtggatctatttgaacatatttgggccgttgatagacttgaaagattaggaatctccaggtacttccaaaaggagatcgaacaatgcatggattatgtaaacaggcattggactgaggacggtatttgttgggcaaggaactctgatgtcaaagaggtggacgacacagctatggcctttagacttcttaggttgcacggctacagcgtcagtcctgatgtgtttaaaaacttcgaaaaggacggtgaatttttcgcatttgtcggacagtctaatcaagctgttaccggtatgtacaacttaaacagagcaagccagatatccttcccaggcgaggatgtgcttcatagagctggtgccttctcatatgagttcttgaggagaaaagaagcagagggagctttgagggacaagtggatcatttctaaagatctacctggtgaagttgtgtatactttggattttccatggtacggcaacttacctagagtcgaggccagagactacctagagcaatacggaggtggtgatgacgtttggattggcaagacattgtataggatgccacttgtaaacaatgatgtatatttggaattggcaagaatggatttcaaccactgccaggctttgcatcagttagagtggcaaggactaaaaagatggtatactgaaaataggttgatggactttggtgtcgcccaagaagatgcccttagagcttattttcttgcagccgcatctgtttacgagccttgtagagctgccgagaggcttgcatgggctagagccgcaatactagctaacgccgtgagcacccacttaagaaatagcccatcattcagagaaaggttagagcattctcttaggtgtagacctagtgaagagacagatggctcctggtttaactcctcaagtggctctgatgcagttttagtaaaggctgtcttaagacttactgattcattagccagggaagcacagccaatccatggaggtgacccagaagatattatacacaagttgttaagatctgcttgggccgagtgggttagggaaaaggcagacgctgccgatagcgtgtgcaatggtagttctgcagtagaacaagagggatcaagaatggtccatgataaacagacctgtctattattggctagaatgatcgaaatttctgccggtagggcagctggtgaagcagccagtgaggacggcgatagaagaataattcaattaacaggctccatctgcgacagtcttaagcaaaaaatgctagtttcacaggaccctgaaaaaaatgaagagatgatgtctcacgtggatgacgaattgaagttgaggattagagagttcgttcaatatttgcttagactaggtgaaaaaaagactggatctagcgaaaccaggcaaacatttttaagtatagtgaaatcatgttactatgctgctcattgcccacctcatgtcgttgatagacacattagtagagtgattttcgagccagtaagtgccgcaaagtaaccgcgg

SEQ ID NO: 228 - protein, 827 aa, Zea mays
MVLSSSCTTVPHLSSLAVVQLGPWSSRIKKKTDTVAVPAAAGRWRRALARAQHTSESAAVAKGSSLTPIVRTDAESRRTRWPTDDDDAEPLVDEIRAMLTSMSDGDISVSAYDTAWVGLVPRLDGGEGPQFPAAVRWIRNNQLPDGSWGDAALFSAYDRLINTLACVVTLTRWSLEPEMRGRGLSFLGRNMWKLATEDEESMPIGFELAFPSLIELAKSLGVHDFPYDHQALQGIYSSREIKMKRIPKEVMHTVPTSILHSLEGMPGLDWAKLLKLQSSDGSFLFSPAATAYALMNTGDDRCFSYIDRTVKKFNGGVPNVYPVDLFEHIWAVDRLERLGISRYFQKEIEQCMDYVNRHWTEDGICWARNSDVKEVDDTAMAFRLLRLHGYSVSPDVFKNFEKDGEFFAFVGQSNQAVTGMYNLNRASQISFPGEDVLHRAGAFSYEFLRRKEAEGALRDKWIISKDLPGEVVYTLDFPWYGNLPRVEARDYLEQYGGGDDVWIGKTLYRMPLVNNDVYLELARMDFNHCQALHQLEWQGLKRWYTENRLMDFGVAQEDALRAYFLAAASVYEPCRAAERLAWARAAILANAVSTHLRNSPSFRERLEHSLRCRPSEETDGSWFNSSSGSDAVLVKAVLRLTDSLAREAQPIHGGDPEDIIHKLLRSAWAEWVREKADAADSVCNGSSAVEQEGSRMVHDKQTCLLLARMIEISAGRAAGEAASEDGDRRIIQLTGSICDSLKQKMLVSQDPEKNEEMMSHVDDELKLRIREFVQYLLRLGEKKTGSSETRQTFLSIVKSCYYAAHCPPHVVDRHISRVIFEPVSAAK

SEQ ID NO: 229 - DNA, 2570 bp, Artificial Sequence
  Codon-optimized CDPS
cttcttcactaaatacttagacagagaaaacagagctttttaaagccatgtctcttcagtatcatgttctaaactccattccaagtacaacctttctcagttctactaaaacaacaatatcttcttctttccttaccatctcaggatctcctctcaatgtcgctagagacaaatccagaagcggttccatacattgttcaaagcttcgaactcaagaatacattaattctcaagaggttcaacatgatttgcctctaatacatgagtggcaacagcttcaaggagaagatgctcctcagattagtgttggaagtaatagtaatgcattcaaagaagcagtgaagagtgtgaaaacgatcttgagaaacctaacggacggggaaattacgatatcggcttacgatacagcttgggttgcattgatcgatgccggagataaaactccggcgtttccctccgccgtgaaatggatcgccgagaaccaactttccgatggttcttggggagatgcgtatctcttctcttatcatgatcgtctcatcaatacccttgcatgcgtcgttgctctaagatcatggaatctctttcctcatcaatgcaacaaaggaatcacgtttttccgggaaaatattgggaagctagaagacgaaaatgatgagcatatgccaatcggattcgaagtagcattcccatcgttgcttgagatagctcgaggaataaacattgatgtaccgtacgattctccggtcttaaaagatatatacgccaagaaagagctaaagcttacaaggataccaaaagagataatgcacaagataccaacaacattgttgcatagtttggaggggatgcgtgatttagattgggaaaagctcttgaaacttcaatctcaagacggatctttcctcttctctccttcctctaccgcttttgcattcatgcagacccgagacagtaactgcctcgagtatttgcgaaatgccgtcaaacgtttcaatggaggagttcccaatgtctttcccgtggatcttttcgagcacatatggatagtggatcggttacaacgtttagggatatcgagatactttgaagaagagattaaagagtgtcttgactatgtccacagatattggaccgacaatggcatatgttgggctagatgttcccatgtccaagacatcgatgatacagccatggcatttaggctcttaagacaacatggataccaagtgtccgcagatgtattcaagaactttgagaaagagggagagtttttctgctttgtggggcaatcaaaccaagcagtaaccggtatgttcaacctataccgggcatcacaattggcgtttccaagggaagagatattgaaaaacgccaaagagttttcttataattatctgctagaaaaacgggagagagaggagttgattgataagtggattataatgaaagacttacctggcgagattgggtttgcgttagagattccatggtacgcaagcttgcctcgagtagagacgagattctatattgatcaatatggtggagaaaacgacgtttggattggcaagactctttataggatgccatacgtgaacaataatggatatctggaattagcaaaacaagattacaacaattgccaagctcagcatcagctcgaatgggacatattccaaaagtggtatgaagaaaataggttaagtgagtggggtgtgcgcagaagtgagcttctcgagtgttactacttagcggctgcaactatatttgaatcagaaaggtcacatgagagaatggtttgggctaagtcaagtgtattggttaaagccatttcttcttcttttggggaatcctctgactccagaagaagcttctccgatcagtttcatgaatacattgccaatgctcgacgaagtgatcatcactttaatgacaggaacatgagattggaccgaccaggatcggttcaggccagtcggcttgccggagtgttaatcgggactttgaatcaaatgtcttttgaccttttcatgtctcatggccgtgacgttaacaatctcctctatctatcgtggggagattggatggaaaaatggaaactatatggagatgaaggagaaggagagctcatggtgaagatgataattctaatgaagaacaatgacctaactaacttcttcacccacactcacttcgttcgtctcgcggaaatcatcaatcgaatctgtcttcctcgccaatacttaaaggcaaggagaaacgatgagaaggagaagacaataaagagtatggagaaggagatggggaaaatggttgagttagcattgtcggagagtgacacatttcgtgacgtcagcatcacgtttcttgatgtagcaaaagcattttactactttgctttatgtggcgatcatctccaaactcacatctccaaagtcttgtttcaaaaagtctagtaacctcatcatcatcatcgatccattaacaatcagtggatcgatgtatccatagatgcgtgaataatatttcatgtagagaaggagaacaaattagatcatgtagggttatca

SEQ ID NO: 230 - protein, 802 aa, Arabidopsis thaliana
MSLQYHVLNSIPSTTFLSSTKTTISSSFLTISGSPLNVARDKSRSGSIHCSKLRTQEYINSQEVQHDLPLIHEWQQLQGEDAPQISVGSNSNAFKEAVKSVKTILRNLTDGEITISAYDTAWVALIDAGDKTPAFPSAVKWIAENQLSDGSWGDAYLFSYHDRLINTLACVVALRSWNLFPHQCNKGITFFRENIGKLEDENDEHMPIGFEVAFPSLLEIARGINIDVPYDSPVLKDIYAKKELKLTRIPKEIMHKIPTTLLHSLEGMRDLDWEKLLKLQSQDGSFLFSPSSTAFAFMQTRDSNCLEYLRNAVKRFNGGVPNVFPVDLFEHIWIVDRLQRLGISRYFEEEIKECLDYVHRYWTDNGICWARCSHVQDIDDTAMAFRLLRQHGYQVSADVFKNFEKEGEFFCFVGQSNQAVTGMFNLYRASQLAFPREEILKNAKEFSYNYLLEKREREELIDKWIIMKDLPGEIGFALEIPWYASLPRVETRFYIDQYGGENDVWIGKTLYRMPYVNNNGYLELAKQDYNNCQAQHQLEWDIFQKWYEENRLSEWGVRRSELLECYYLAAATIFESERSHERMVWAKSSVLVKAISSSFGESSDSRRSFSDQFHEYIANARRSDHHFNDRNMRLDRPGSVQASRLAGVLIGTLNQMSFDLFMSHGRDVNNLLYLSWGDWMEKWKLYGDEGEGELMVKMIILMKNNDLTNFFTHTHFVRLAEIINRICLPRQYLKARRNDEKEKTIKSMEKEMGKMVELALSESDTFRDVSITFLDVAKAFYYFALCGDHLQTHISKVLFQKV

SEQ ID NO: 231 - DNA, 2355 bp, Artificial Sequence
  Codon-optimized KS
atgaatttgagtttgtgtatagcatctccactattgaccaaatctaatagaccagctgctttatcagcaattcatacagctagtacatcccatggtggccaaaccaaccctacgaatctgataatcgatacgaccaaggagagaatacaaaaacaattcaaaaatgttgaaatttcagtttcttcttatgatactgcgtgggttgccatggttccatcacctaattctccaaagtctccatgtttcccagaatgtttgaattggctgattaacaaccagttgaatgatggatcttggggtttagtcaatcacacgcacaatcacaaccatccacttttgaaagattctttatcctcaactttggcttgcatcgtggccctaaagagatggaacgtaggtgaggatcagattaacaaggggcttagtttcattgaatctaacttggcttccgcgactgaaaaatctcaaccatctccaataggattcgatatcatctttccaggtctgttagagtacgccaaaaatctagatatcaacttactgtctaagcaaactgatttctcactaatgttacacaagagagaattagaacaaaagagatgtcattcaaacgaaatggatggttacctagcttatatctctgaaggtcttggtaatctttacgattggaatatggtgaaaaagtaccagatgaaaaatggctcagttttcaattccccttctgcaactgcggcagcattcattaaccatcaaaatccaggatgcctgaactatttgaattcactactagacaaattcggcaacgcagttccaactgtataccctcacgatttgtttatcagattgagtatggtggatacaattgaaagacttggtatatcccaccactttagagtcgagatcaaaaatgttttggatgagacataccgttgttgggtggagagagatgaacaaatctttatggatgttgtgacgtgcgcgttggcctttagattgttgcgtattaacggttacgaagttagtccagatccacttgccgaaattacaaacgaattagctttaaaggatgaatacgccgctcttgaaacatatcatgcgtcacatatcctttaccaagaggacttatcatctggaaaacaaattcttaaatctgctgatttcctgaaggaaatcatatccactgatagtaatagactgtccaaactgatccataaagaggttgaaaatgcacttaagttccctattaacaccggcttagaacgtattaacacaagacgtaacatccagctttacaacgtagacaatactagaatcttgaaaaccacttaccattcttccaacatatcaaacactgattacctaagattagctgttgaagatttctacacatgtcagtctatctatagagaagagctgaaaggattagagagatgggtcgttgagaataagctagatcaattgaaatttgccagacaaaagacagcttattgttacttctcagttgccgccactttatcaagtccagaattgtcagatgcacgtatttcttgggctaaaaacggaattttgacaactgttgttgatgatttctttgatattggcgggacaatcgacgaattgacaaacctgattcaatgcgttgaaaagtggaatgtcgatgtcgataaagactgttgctcagaacatgttagaatactgttcttggctctgaaagatgctatctgttggatcggggatgaggctttcaaatggcaagctagagatgtgacgtctcacgtcattcaaacctggctagaactgatgaactctatgttgagagaagcaatttggactagagatgcatacgttcctacattaaacgagtatatggaaaacgcttatgtctcctttgctttgggtcctatcgttaagcctgccatatactttgtaggaccaaagctatccgaggaaatcgtcgaatcatcagaataccataacttgttcaagttaatgtccacacaaggcagattacttaatgatattcattctttcaaaagagagtttaaggaaggaaagttaaatgctgttgctctgcatctttctaatggcgaaagtggtaaagtcgaagaggaagtagttgaggaaatgatgatgatgatcaaaaacaagagaaaggagttgatgaaactaatcttcgaagagaacggttcaattgttcctagagcatgtaaggatgcattttggaacatgtgtcatgtgctaaactttttctacgcaaacgacgatggttttactgggaacacaatactagatacagtaaaagacatcatatacaaccctttggtcttagtaaacgaaaacgaggagcaaagataa

SEQ ID NO: 232 - protein, 784 aa, Stevia rebaudiana
MNLSLCIASPLLTKSNRPAALSAIHTASTSHGGQTNPTNLIIDTTKERIQKQFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATEKSQPSPIGFDIIFPGLLEYAKNLDINLLSKQTDFSLMLHKRELEQKRCHSNEMDGYLAYISEGLGNLYDWNMVKKYQMKNGSVFNSPSATAAAFINHQNPGCLNYLNSLLDKFGNAVPTVYPHDLFIRLSMVDTIERLGISHHFRVEIKNVLDETYRCWVERDEQIFMDVVTCALAFRLLRINGYEVSPDPLAEITNELALKDEYAALETYHASHILYQEDLSSGKQILKSADFLKEIISTDSNRLSKLIHKEVENALKFPINTGLERINTRRNIQLYNVDNTRILKTTYHSSNISNTDYLRLAVEDFYTCQSIYREELKGLERWVVENKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 233 - DNA, 2355 bp, Artificial Sequence
  Codon-optimized KS
atgaatctgtccctttgtatagctagtccactgttgacaaaatcttctagaccaactgctctttctgcaattcatactgccagtactagtcatggaggtcaaacaaacccaacaaatttgataatcgatactactaaggagagaatccaaaagctattcaaaaatgttgaaatctcagtatcatcttatgacaccgcatgggttgcaatggtgccatcacctaattccccaaaaagtccatgttttccagagtgcttgaattggttaatcaataatcagttaaacgatggttcttggggtttagtcaaccacactcataaccacaatcatccattattgaaggactctttatcatcaacattagcctgtattgttgcattgaaaagatggaatgtaggtgaagatcaaatcaacaagggtttatcattcatagaatccaatctagcttctgctaccgacaaatcacaaccatctccaatcgggttcgacataatcttccctggtttgctggagtatgccaaaaaccttgatatcaacttactgtctaaacaaacagatttctctttgatgctacacaaaagagagttagagcagaaaagatgccattctaacgaaattgacgggtacttagcatatatctcagaaggtttgggtaatttgtatgactggaacatggtcaaaaagtatcagatgaaaaatggatccgtattcaattctccttctgcaactgccgcagcattcattaatcatcaaaaccctgggtgtcttaactacttgaactcactattagataagtttggaaatgcagttccaacagtctatcctttggacttgtacatcagattatctatggttgacactatagagagattaggtatttctcatcatttcagagttgagatcaaaaatgttttggacgagacatacagatgttgggtcgaaagagatgagcaaatctttatggatgtcgtgacctgcgctctggcttttagattgctaaggatacacggatacaaagtatctcctgatcaactggctgagattacaaacgaactggctttcaaagacgaatacgccgcattagaaacataccatgcatcccaaatactttaccaggaagacctaagttcaggaaaacaaatcttgaagtctgcagatttcctgaaaggcattctgtctacagatagtaataggttgtctaaattgatacacaaggaagtagaaaacgcactaaagtttcctattaacactggtttagagagaatcaatactaggagaaacattcagctgtacaacgtagataatacaaggattcttaagaccacctaccatagttcaaacatttccaacacctattacttaagattagctgtcgaagacttttacacttgtcaatcaatctacagagaggagttaaagggcctagaaagatgggtagttcaaaacaagttggatcaactgaagtttgctagacagaagacagcatactgttatttctctgttgctgctaccctttcatccccagaattgtctgatgccagaataagttgggccaaaaatggtattcttacaactgtagtcgatgatttctttgatattggaggtactattgatgaactgacaaatcttattcaatgtgttgaaaagtggaacgtggatgtagataaggattgctgcagtgaacatgtgagaatacttttcctggctctaaaagatgcaatatgttggattggcgacgaggccttcaagtggcaagctagagatgttacatctcatgtcatccaaacttggcttgaactgatgaactcaatgctaagagaagcaatctggacaagagatgcatacgttccaacattgaacgaatacatggaaaacgcttacgtctcatttgccttgggtcctattgttaagccagccatatactttgttgggccaaagttatccgaagagattgttgagtcttccgaatatcataacctattcaagttaatgtcaacacaaggcagacttctgaacgatatccactccttcaaaagagaattcaaggaaggtaagctaaacgctgttgctttgcacttgtctaatggtgaatctggcaaagtggaagaggaagtcgttgaggaaatgatgatgatgatcaaaaacaagagaaaggaattgatgaaattgattttcgaggaaaatggttcaatcgtacctagagcttgtaaagatgctttttggaatatgtgccatgttcttaacttcttttacgctaatgatgatggcttcactggaaatacaatattggatacagttaaagatatcatctacaacccacttgttttggtcaatgagaacgaggaacaaagataa

SEQ ID NO: 234 - protein, 784 aa, Stevia rebaudiana
MNLSLCIASPLLTKSSRPTALSAIHTASTSHGGQTNPTNLIIDTTKERIQKLFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATDKSQPSPIGFDIIFPGLLEYAKNLDINLLSKQTDFSLMLHKRELEQKRCHSNEIDGYLAYISEGLGNLYDWNMVKKYQMKNGSVFNSPSATAAAFINHQNPGCLNYLNSLLDKFGNAVPTVYPLDLYIRLSMVDTIERLGISHHFRVEIKNVLDETYRCWVERDEQIFMDVVTCALAFRLLRIHGYKVSPDQLAEITNELAFKDEYAALETYHASQILYQEDLSSGKQILKSADFLKGILSTDSNRLSKLIHKEVENALKFPINTGLERINTRRNIQLYNVDNTRILKTTYHSSNISNTYYLRLAVEDFYTCQSIYREELKGLERWVVQNKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 235 - DNA, 1773 bp, Artificial Sequence
  Codon-optimized KS
atggctatgccagtgaagctaacacctgcgtcattatccttaaaagctgtgtgctgcagattctcatccggtggccatgctttgagattcgggagtagtctgccatgttggagaaggacccctacccaaagatctacttcttcctctactactagaccagctgccgaagtgtcatcaggtaagagtaaacaacatgatcaggaagctagtgaagcgactatcagacaacaattacaacttgtggatgtcctggagaatatgggaatatccagacattttgctgcagagataaagtgcatactagacagaacttacagatcttggttacaaagacacgaggaaatcatgctggacactatgacatgtgctatggcttttagaatcctaagattgaacggatacaacgtttcatcagatgaactataccacgttgtagaggcatctggtctgcataattctttgggtgggtatcttaacgataccagaacactacttgaattacacaaggcttcaacagttagtatctctgaggatgaatctatcttagattcaattggctctagatccagaacattgcttagagaacaattggagtctggtggcgcactgagaaagccttctttattcaaagaggttgaacatgcactggatggacctttttacaccacacttgatagacttcatcataggtggaatattgaaaacttcaacattattgagcaacacatgttggagactccatacttatctaaccagcatacatcaagggatatcctagcattgtcaattagagatttttcctcctcacaattcacttatcaacaagagctacagcatctggagagttgggttaaggaatgtagattagatcaactacagttcgcaagacagaaattagcgtacttttacctatcagccgcaggcaccatgttttctcctgagctttctgatgcgagaacattatgggccaaaaacggggtgttgacaactattgttgatgatttctttgatgttgccggttctaaagaggaattggaaaacttagtcatgctggtcgaaatgtgggatgaacatcacaaagttgaattctattctgagcaggtcgaaatcatcttctcttccatctacgattctgtcaaccaattgggtgagaaggcctctttggttcaagacagatcaattacaaaacaccttgttgaaatatggttagacttgttaaagtccatgatgacggaagttgaatggagactgtcaaaatacgtgcctacagaaaaggaatacatgattaatgcctctcttatcttcggcctaggtccaatcgttttaccagctttgtatttcgttggtccaaagatttcagaaagtatagtaaaggacccagaatatgatgaattgttcaaactaatgtcaacatgtggtagattgttgaatgacgtgcaaacgttcgaaagagaatacaatgagggtaaactgaattctgtcagtctattggttcttcacggaggcccaatgtctatttcagacgcaaagaggaaattacaaaagcctattgatacgtgtagaagagatcttctttctttggtccttagagaagagtctgtagtaccaagaccatgtaaggaactattctggaaaatgtgtaaagtgtgctatttcttttactcaacaactgatgggttttctagtcaagtcgaaagagcaaaagaggtagacgctgtcataaatgagccactgaagttgcaaggttctcatacactggtatctgatgtttaa

SEQ ID NO: 236 - protein, 590 aa, Zea mays
MAMPVKLTPASLSLKAVCCRFSSGGHALRFGSSLPCWRRTPTQRSTSSSTTRPAAEVSSGKSKQHDQEASEATIRQQLQLVDVLENMGISRHFAAEIKCILDRTYRSWLQRHEEIMLDTMTCAMAFRILRLNGYNVSSDELYHVVEASGLHNSLGGYLNDTRTLLELHKASTVSISEDESILDSIGSRSRTLLREQLESGGALRKPSLFKEVEHALDGPFYTTLDRLHHRWNIENFNIIEQHMLETPYLSNQHTSRDILALSIRDFSSSQFTYQQELQHLESWVKECRLDQLQFARQKLAYFYLSAAGTMFSPELSDARTLWAKNGVLTTIVDDFFDVAGSKEELENLVMLVEMWDEHHKVEFYSEQVEIIFSSIYDSVNQLGEKASLVQDRSITKHLVEIWLDLLKSMMTEVEWRLSKYVPTEKEYMINASLIFGLGPIVLPALYFVGPKISESIVKDPEYDELFKLMSTCGRLLNDVQTFEREYNEGKLNSVSLLVLHGGPMSISDAKRKLQKPIDTCRRDLLSLVLREESVVPRPCKELFWKMCKVCYFFYSTTDGFSSQVERAKEVDAVINEPLKLQGSHTLVSDV

SEQ ID NO: 237 - DNA, 2232 bp, Artificial Sequence
  Codon-optimized KS
atgcagaacttccatggtacaaaggaaaggatcaaaaagatgtttgacaagattgaattgtccgtttcttcttatgatacagcctgggttgcaatggtcccatcccctgattgcccagaaacaccttgttttccagaatgtactaaatggatcctagaaaatcagttgggtgatggtagttggtcacttcctcatggcaatccacttctagttaaagatgcattatcttccactcttgcttgtattctggctcttaaaagatggggaatcggtgaggaacagattaacaaaggactgagattcatagaactcaactctgctagtgtaaccgataacgaacaacacaaaccaattggatttgacattatctttccaggtatgattgaatacgctatagacttagacctgaatctaccactaaaaccaactgacattaactccatgttgcatcgtagagcccttgaattgacatcaggtggaggcaaaaatctagaaggtagaagagcttacttggcctacgtctctgaaggaatcggtaagctgcaagattgggaaatggctatgaaataccaacgtaaaaacggatctctgttcaatagtccatcaacaactgcagctgcattcatccatatacaagatgctgaatgcctccactatattcgttctcttctccagaaatttggaaacgcagtccctacaatataccctctcgatatctatgccagactttcaatggtagatgccctggaacgtcttggtattgatagacatttcagaaaggagagaaagttcgttctggatgaaacatacagattttggttgcaaggagaagaggagattttctccgataacgcaacctgtgctttggccttcagaatattgagacttaatggttacgatgtctctcttgaagatcacttctctaactctctgggcggttacttaaaggactcaggagcagctttagaactgtacagagccctccaattgtcttacccagacgagtccctcctggaaaagcaaaattctagaacttcttacttcttaaaacaaggtttatccaatgtctccctctgtggtgacagattgcgtaaaaacataattggagaggtgcatgatgctttaaacttttccgaccacgctaacttacaaagattagctattcgtagaaggattaagcattacgctactgacgatacaaggattctaaaaacttcctacagatgctcaacaatcggtaaccaagattttctaaaacttgcagtggaagatttcaatatctgtcaatcaatacaaagagaggaattcaagcatattgaaagatgggtcgttgaaagacgtctagacaagttaaagttcgctagacaaaaagaggcctattgctatttctcagccgcagcaacattgtttgcccctgaattgtctgatgctagaatgtcttgggccaaaaatggtgtattgacaactgtggttgatgatttcttcgatgtcggaggctctgaagaggaattagttaacttgatagaattgatcgagcgttgggatgtgaatggcagtgcagatttttgtagtgaggaagttgagattatctattctgctatccactcaactatctctgaaataggtgataagtcatttggctggcaaggtagagatgtaaagtctcaagttatcaagatctggctggacttattgaaatcaatgttaactgaagctcaatggtcttcaaacaagtctgttcctaccctagatgagtatatgacaaccgcccatgtttcattcgcacttggtccaattgtacttccagccttatacttcgttggcccaaagttgtcagaagaggttgcaggtcatcctgaactactaaacctctacaaagtcacatctacttgtggcagactactgaatgattggagaagttttaagagagaatccgaggaaggtaagctcaacgctattagtttatacatgatccactccggtggtgcttctacagaagaggaaacaatcgaacatttcaaaggtttgattgattctcagagaaggcaactgttacaattggtgttgcaagagaaggatagtatcatacctagaccatgtaaagatctattttggaatatgattaagttattacacactttctacatgaaagatgatggcttcacctcaaatgagatgaggaatgtagttaaggcaatcattaacgaaccaatctcactggatgaattatga

SEQ ID NO: 238 - protein, 775 aa, Populus trichocarpa
MSCIRPWFCPSSISATLTDPASKLVTGEFKTTSLNFHGTKERIKKMFDKIELSVSSYDTAWVAMVPSPDCPETPCFPECTKWILENQLGDGSWSLPHGNPLLVKDALSSTLACILALKRWGIGEEQINKGLRFIELNSASVTDNEQHKPIGFDIIFPGMIEYAKDLDLNLPLKPTDINSMLHRRALELTSGGGKNLEGRRAYLAYVSEGIGKLQDWEMAMKYQRKNGSLFNSPSTTAAAFIHIQDAECLHYIRSLLQKFGNAVPTIYPLDIYARLSMVDALERLGIDRHFRKERKFVLDETYRFWLQGEEEIFSDNATCALAFRILRLNGYDVSLEDHFSNSLGGYLKDSGAALELYRALQLSYPDESLLEKQNSRTSYFLKQGLSNVSLCGDRLRKNIIGEVHDALNFPDHANLQRLAIRRRIKHYATDDTRILKTSYRCSTIGNQDFLKLAVEDFNICQSIQREEFKHIERWVVERRLDKLKFARQKEAYCYFSAAATLFAPELSDARMSWAKNGVLTTVVDDFFDVGGSEEELVNLIELIERWDVNGSADFCSEEVEIIYSAIHSTISEIGDKSFGWQGRDVKSHVIKIWLDLLKSMLTEAQWSSNKSVPTLDEYMTTAHVSFALGPIVLPALYFVGPKLSEEVAGHPELLNLYKVMSTCGRLLNDWRSFKRESEEGKLNAISLYMIHSGGASTEEETIEHFKGLIDSQRRQLLQLVLQEKDSIIPRPCKDLFWNMIKLLHTFYMKDDGFTSNEMRNVVKAIINEPISLDEL

SEQ ID NO: 239 - DNA, 2952 bp, Artificial Sequence
  Codon-optimized CDPS-KS
atggaatttgatgaaccattggttgacgaagcaagatctttagtgcagcgtactttacaagattatgatgacagatacggcttcggtactatgtcatgtgctgcttatgatacagcctgggtgtctttagttacaaaaacagtcgatgggagaaaacaatggcttttcccagagtgttttgaatttctactagaaacacaatctgatgccggaggatgggaaatcgggaattcagcaccaatcgacggtatattgaatacagctgcatccttacttgctctaaaacgtcacgttcaaactgagcaaatcatccaacctcaacatgaccataaggatctagcaggtagagctgaacgtgccgctgcatctttgagagcacaattggctgcattggatgtgtctacaactgaacacgtcggttttgagataattgttcctgcaatgctagacccattagaagccgaagatccatctctagttttcgattttccagctaggaaacctttgatgaagattcatgatgctaagatgagtagattcaggccagaatacttgtatggcaaacaaccaatgaccgccttacattcattagaggctttcataggcaaaatcgacttcgataaggtaagacaccaccgtacccatgggtctatgatgggttctccttcatctaccgcagcctacttaatgcacgcttcacaatgggatggtgactcagaggcttaccttagacacgtgattaaacacgcagcagggcagggaactggtgctgtaccatctgctttcccatcaacacattttgagtcatcttggattcttaccacattgtttagagctggattttcagcttctcatcttgcctgtgatgagttgaacaagttggtcgagatacttgagggctcattcgagaaggaaggtggggcaatcggttacgctccagggtttcaagcagatgttgatgatactgctaaaacaataagtacattagcagtccttggaagagatgctacaccaagacaaatgatcaaggtatttgaagctaatacacattttagaacataccctggtgaaagagatccttctttgacagctaattgtaatgctctatcagccttactacaccaaccagatgcagcaatgtatggatctcaaattcaaaagattaccaaatttgtctgtgactattggtggaagtctgatggtaagattaaagataagtggaacacttgctacttgtacccatctgtcttattagttgaggttttggttgatcttgttagtttattggagcagggtaaattgcctgatgttttggatcaagagcttcaatacagagtcgccatcacattgttccaagcatgtttaaggccattactagaccaagatgccgaaggatcatggaacaagtctatcgaagccacagcctacggcatccttatcctaactgaagctaggagagtttgtttcttcgacagattgtctgagccattgaatgaggcaatccgtagaggtatcgctttcgccgactctatgtctggaactgaagctcagttgaactacatttggatcgaaaaggttagttacgcacctgcattattgactaaatcctatttgttagcagcaagatgggctgctaagtctcctttaggcgcttccgtaggctcttctttgtggactccaccaagagaaggattggataagcatgtcagattattccatcaagctgagttattcagatcccttccagaatgggaattaagagcctccatgattgaagcagctttgttcacaccacttctaagagcacatagactagacgttttccctagacaagatgtaggtgaagacaaatatcttgatgtagttccattcttttggactgccgctaacaacagagatagaacttacgcttccactctattcctttacgatatgtgttttatcgcaatgttaaacttccagttagacgaattcatggaggccacagccggtatcttattcagagatcatatggatgatttgaggcaattgattcatgatcttttggcagagaaaacttccccaaagagttctggtagaagtagtcagggcacaaaagatgctgactcaggtatagaggaagacgtgtcaatgtccgattcagcttcagattcccaggatagaagtccagaatacgacttggttttcagtgcattgagtacctttacaaaacatgtcttgcaacacccatctatacaaagtgcctctgtatgggatagaaaactacttgctagagagatgaaggcttacttacttgctcatatccaacaagcagaagattcaactccattgtctgaattgaaagatgtgcctcaaaagactgatgtaacaagagtttctacatctactactaccttctttaactgggttagaacaacttccgcagaccatatatcctgcccatactccttccactttgtagcatgccatctaggcgcagcattgtcacctaaagggtctaacggtgattgctatccttcagctggtgagaagttcttggcagctgcagtctgcagacatttggccaccatgtgtagaatgtacaacgatcttggatcagctgaacgtgattctgatgaaggtaatttgaactccttggacttccctgaattcgccgattccgcaggaaacggagggatagaaattcagaaggccgctctattaaggttagctgagtttgagagagattcatacttagaggccttccgtcgtttacaagatgaatccaatagagttcacggtccagccggtggtgatgaagccagattgtccagaaggagaatggcaatccttgaattcttcgcccagcaggtagatttgtacggtcaagtatacgtcattagggatatttccgctcgtattcctaaaaacgaggttgagaaaaagagaaaattggatgatgctttcaattga

SEQ ID NO: 240 - protein, 983 aa, Phomopsis amygdali
MEFDEPLVDEARSLVQRTLQDYDDRYGFGTMSCAAYDTAWVSLVTKTVDGRKQWLFPECFEFLLETQSDAGGWEIGNSAPIDGILNTAASLLALKRHVQTEQIIQPQHDHKDLAGRAERAAASLRAQLAALDVSTTEHVGFEIIVPAMLDPLEAEDPSLVFDFPARKPLMKIHDAKMSRFRPEYLYGKQPMTALHSLEAFIGKIDFDKVRHHRTHGSMMGSPSSTAAYLMHASQWDGDSEAYLRHVIKHAAGQGTGAVPSAFPSTHFESSWILTTLFRAGFSASHLACDELNKLVEILEGSFEKEGGAIGYAPGFQADVDDTAKTISTLAVLGRDATPRQMIKVFEANTHFRTYPGERDPSLTANCNALSALLHQPDAAMYGSQIQKITKFVCDYWWKSDGKIKDKWNTCYLYPSVLLVEVLVDLVSLLEQGKLPDVLDQELQYRVAITLFQACLRPLLDQDAEGSWNKSIEATAYGILILTEARRVCFFDRLSEPLNEAIRRGIAFADSMSGTEAQLNYIWIEKVSYAPALLTKSYLLAARWAAKSPLGASVGSSLWTPPREGLDKHVRLFHQAELFRSLPEWELRASMIEAALFTPLLRAHRLDVFPRQDVGEDKYLDVVPFFWTAANNRDRTYASTLFLYDMCFIAMLNFQLDEFMEATAGILFRDHMDDLRQLIHDLLAEKTSPKSSGRSSQGTKDADSGIEEDVSMSDSASDSQDRSPEYDLVFSALSTFTKHVLQHPSIQSASVWDRKLLAREMKAYLLAHIQQAEDSTPLSELKDVPQKTDVTRVSTSTTTFFNWVRTTSADHISCPYSFHFVACHLGAALSPKGSNGDCYPSAGEKFLAAAVCRHLATMCRMYNDLGSAERDSDEGNLNSLDFPEFADSAGNGGIEIQKAALLRLAEFERDSYLEAFRRLQDESNRVHGPAGGDEARLSRRRMAILEFFAQQVDLYGQVYVIRDISARIPKNEVEKKRKLDDAFN

SEQ ID NO: 241 - DNA, 2646 bp, Artificial Sequence
  Codon-optimized CDPS-KS
atggcttctagtacacttatccaaaacagatcatgtggcgtcacatcatctatgtcaagttttcaaatcttcagaggtcaaccactaagatttcctggcactagaaccccagctgcagttcaatgcttgaaaaagaggagatgccttaggccaaccgaatccgtactagaatcatctcctggctctggttcatatagaatagtaactggcccttctggaattaaccctagttctaacgggcacttgcaagagggttccttgactcacaggttaccaataccaatggaaaaatctatcgataacttccaatctactctatatgtgtcagatatttggtctgaaacactacagagaactgaatgtttgctacaagtaactgaaaacgtccagatgaatgagtggattgaggaaattagaatgtactttagaaatatgactttaggtgaaatttccatgtccccttacgacactgcttgggtggctagagttccagcgttggacggttctcatgggcctcaattccacagatctttgcaatggattatcgacaaccaattaccagatggggactggggcgaaccttctcttttcttgggttacgatagagtttgtaatactttagcctgtgtgattgcgttgaaaacatggggtgttggggcacaaaacgttgaaagaggaattcagttcctacaatctaacatatacaagatggaggaagatgacgctaatcatatgccaataggattcgaaatcgtattccctgctatgatggaagatgccaaagcattaggtttggatttgccatacgatgctactattttgcaacagatttcagccgaaagagagaaaaagatgaaaaagatcccaatggcaatggtgtacaaatacccaaccactttacttcactccttagaaggcttgcatagagaagttgattggaataagttgttacaattacaatctgaaaatggtagttttctttattcacctgcttcaaccgcatgcgccttaatgtacactaaggacgttaaatgttttgattacttaaaccagttgttgatcaagttcgaccacgcatgcccaaatgtatatccagtcgatctattcgaaagattatggatggttgacagattgcagagattagggatctccagatactttgaaagagagattagagattgtttacaatacgtctacagatattggaaagattgtggaatcggatgggcttctaactcttccgtacaagatgttgatgatacagccatggcgtttagacttttaaggactcatggtttcgacgtaaaggaagattgctttagacagtttttcaaggacggagaattcttctgcttcgcaggccaatcatctcaagcagttacaggcatgtttaatctttcaagagccagtcaaacattgtttccaggagaatctttattgaaaaaggctagaaccttctctagaaacttcttgagaacaaagcatgagaacaacgaatgtttcgataaatggatcattactaaagatttggctggtgaagtcgagtataacttgaccttcccatggtatgcctctttgcctagattagaacataggacatacttagatcaatatggaatcgatgatatctggataggcaaatctttatacaaaatgcctgctgttaccaacgaagttttcctaaagttggcaaaggcagactttaacatgtgtcaagctctacacaaaaaggaattggaacaagtgataaagtggaacgcgtcctgtcaattcagagatcttgaattcgccagacaaaaatcagtagaatgctattttgctggtgcagccacaatgttcgaaccagaaatggttcaagctagattagtctgggcaagatgttgtgtattgacaactgtcttagacgattactttgaccacgggacacctgttgaggaacttagagtgtttgttcaagctgtcagaacatggaatccagagttgatcaacggtttgccagagcaagctaaaatcttgtttatgggcttatacaaaacagttaacacaattgcagaggaagcattcatggcacagaaaagagacgtccatcatcatttgaaacactattgggacaagttgataacaagtgccctaaaggaggccgaatgggcagagtcaggttacgtcccaacatttgatgaatacatggaagtagctgaaatttctgttgctctagaaccaattgtctgtagtaccttgttctttgcgggtcatagactagatgaggatgttctagatagttacgattaccatctagttatgcatttggtaaacagagtcggtagaatcttgaatgatatacaaggcatgaagagggaggcttcacaaggtaagatctcatcagttcaaatctacatggaggaacatccatctgttccatctgaggccatggcgatcgctcatcttcaagagttagttgataattcaatgcagcaattgacatacgaagttcttaggttcactgcggttccaaaaagttgtaagagaatccacttgaatatggctaaaatcatgcatgccttctacaaggatactgatggattctcatcccttactgcaatgacaggattcgtcaaaaaggttcttttcgaacctgtgcctgagtaa

SEQ ID NO: 242 - protein, 881 aa, Physcomitrella patens
MASSTLIQNRSCGVTSSMSSFQIFRGQPLRFPGTRTPAAVQCLKKRRCLRPTESVLESSPGSGSYRIVTGPSGINPSSNGHLQEGSLTHRLPIPMEKSIDNFQSTLYVSDIWSETLQRTECLLQVTENVQMNEWIEEIRMYFRNMTLGEISMSPYDTAWVARVPALDGSHGPQFHRSLQWIIDNQLPDGDWGEPSLFLGYDRVCNTLACVIALKTWGVGAQNVERGIQFLQSNIYKMEEDDANHMPIGFEIVFPAMMEDAKALGLDLPYDATILQQISAEREKKMKKIPMAMVYKYPTTLLHSLEGLHREVDWNKLLQLQSENGSFLYSPASTACALMYTKDVKCFDYLNQLLIKFDHACPNVYPVDLFERLWMVDRLQRLGISRYFEREIRDCLQYVYRYWKDCGIGWASNSSVQDVDDTAMAFRLLRTHGFDVKEDCFRQFFKDGEFFCFAGQSSQAVTGMFNLSRASQTLFPGESLLKKARTFSRNFLRTKHENNECFDKWIITKDLAGEVEYNLTFPWYASLPRLEHRTYLDQYGIDDIWIGKSLYKMPAVTNEVFLKLAKADFNMCQALHKKELEQVIKWNASCQFRDLEFARQKSVECYFAGAATMFEPEMVQARLVWARCCVLTTVLDDYFDHGTPVEELRVFVQAVRTWNPELINGLPEQAKILFMGLYKTVNTIAEEAFMAQKRDVHHHLKHYWDKLITSALKEAEWAESGYVPTFDEYMEVAEISVALEPIVCSTLFFAGHRLDEDVLDSYDYHLVMHLVNRVGRILNDIQGMKREASQGKISSVQIYMEEHPSVPSEAMAIAHLQELVDNSMQQLTYEVLRFTAVPKSCKRIHLNMAKIMHAFYKDTDGFSSLTAMTGFVKKVLFEPVPE

SEQ ID NO: 243 - DNA, 2859 bp, Artificial Sequence
  Codon-optimized CDPS-KS
atgcctggtaaaattgaaaatggtaccccaaaggacctcaagactggaaatgattttgtttctgctgctaagagtttactagatcgagctttcaaaagtcatcattcctactacggattatgctcaacttcatgtcaagtttatgatacagcttgggttgcaatgattccaaaaacaagagataatgtaaaacagtggttgtttccagaatgtttccattacctcttaaaaacacaagccgcagatggctcatggggttcattgcctacaacacagacagcgggtatcctagatacagcctcagctgtgctggcattattgtgccacgcacaagagcctttacaaatattggatgtatctccagatgaaatggggttgagaatagaacacggtgtcacatccttgaaacgtcaattagcagtttggaatgatgtggaggacaccaaccatattggcgtcgagtttatcataccagccttactttccatgctagaaaaggaattagatgttccatcttttgaatttccatgtaggtccatcttagagagaatgcacggggagaaattaggtcatttcgacctggaacaagtttacggcaagccaagctcattgttgcactcattggaagcatttctcggtaagctagattttgatcgactatcacatcacctataccacggcagtatgatggcatctccatcttcaacggctgcttatcttattggggctacaaaatgggatgacgaagccgaagattacctaagacatgtaatgcgtaatggtgcaggacatgggaatggaggtatttctggtacatttccaactactcatttcgaatgtagctggattatagcaacgttgttaaaggttggctttactttgaagcaaattgacggcgatggcttaagaggtttatcaaccatcttacttgaggcgcttcgtgatgagaatggtgtcataggctttgcccctagaacagcagatgtagatgacacagccaaagctctattggccttgtcattggtaaaccagccagtgtcacctgatatcatgattaaggtctttgagggcaaagaccattttaccacttttggttcagaaagagatccatcattgacttccaacctgcacgtccttttatctttacttaaacaatctaacttgtctcaataccatcctcaaatcctcaaaacaacattattcacttgtagatggtggtggggttccgatcattgtgtcaaagacaaatggaatttgagtcacctatatccaactatgttgttggttgaagccttcactgaagtgctccatctcattgacggtggtgaattgtctagtctgtttgatgaatcctttaagtgtaagattggtcttagcatctttcaagcggtacttagaataatcctcacccaagacaacgacggctcttggagaggatacagagaacagacgtgttacgcaatattggctttagttcaagcgagacatgtatgctttttcactcacatggttgacagactgcaatcatgtgttgatcgaggtttctcatggttgaaatcttgctcttttcattctcaagacctgacttggacctctaaaacagcttatgaagtgggtttcgtagctgaagcatataaactagctgctttacaatctgcttccctggaggttcctgctgccaccattggacattctgtcacgtctgccgttccatcaagtgatcttgaaaaatacatgagattggtgagaaaaactgcgttattctctccactggatgagtggggtctaatggcttctatcatcgaatcttcatttttcgtaccattactgcaggcacaaagagttgaaatataccctagagataatatcaaggtggacgaagataagtacttgtctattatcccattcacatgggtcggatgcaataataggtctagaactttcgcaagtaacagatggctatacgatatgatgtacctttcattactcggctatcaaaccgacgagtacatggaagctgtagctgggccagtgtttggggatgtttccttgttacatcaaacaattgataaggtgattgataatacaatgggtaaccttgcgagagccaatggaacagtacacagtggtaatggacatcagcacgaatctcctaatataggtcaagtcgaggacaccttgactcgtttcacaaattcagtcttgaatcacaaagacgtccttaactctagctcatctgatcaagatactttgagaagagagtttagaacattcatgcacgctcatataacacaaatcgaagataactcacgattcagtaagcaagcctcatccgatgcgttttcctctcctgaacaatcttactttcaatgggtgaactcaactggtggctcacatgtcgcttgcgcctattcatttgccttctctaattgcctcatgtctgcaaatttgttgcagggtaaagacgcatttccaagcggaacgcaaaagtacttaatctcctctgttatgagacatgccacaaacatgtgtagaatgtataacgactttggctctattgccagagacaacgctgagagaaatgttaatagtattcattttcctgagtttactctctgtaacggaacttctcaaaacctagatgaaaggaaggaaagacttctgaaaatcgcaacttacgaacaagggtatttggatagagcactagaggccttggaaagacagagtagagatgatgccggagacagagctggatctaaagatatgagaaagttgaaaatcgttaagttattctgtgatgttacggacttatacgatcagctctacgttatcaaagatttgtcatcctctatgaagtaa

SEQ ID NO: 244 - protein, 952 aa, Gibberella fujikuroi
MPGKIENGTPKDLKTGNDFVSAAKSLLDRAFKSHHSYYGLCSTSCQVYDTAWVAMIPKTRDNVKQWLFPECFHYLLKTQAADGSWGSLPTTQTAGILDTASAVLALLCHAQEPLQILDVSPDEMGLRIEHGVTSLKRQLAVWNDVEDTNHIGVEFIIPALLSMLEKELDVPSFEFPCRSILERMHGEKLGHFDLEQVYGKPSSLLHSLEAFLGKLDFDRLSHHLYHGSMMASPSSTAAYLIGATKWDDEAEDYLRHVMRNGAGHGNGGISGTFPTTHFECSWIIATLLKVGFTLKQIDGDGLRGLSTILLEALRDENGVIGFAPRTADVDDTAKALLALSLVNQPVSPDIMIKVFEGKDHFTTFGSERDPSLTSNLHVLLSLLKQSNLSQYHPQILKTTLFTCRWWWGSDHCVKDKWNLSHLYPTMLLVEAFTEVLHLIDGGELSSLFDESFKCKIGLSIFQAVLRIILTQDNDGSWRGYREQTCYAILALVQARHVCFFTHMVDRLQSCVDRGFSWLKSCSFHSQDLTWTSKTAYEVGFVAEAYKLAALQSASLEVPAATIGHSVTSAVPSSDLEKYMRLVRKTALFSPLDEWGLMASIIESSFFVPLLQAQRVEIYPRDNIKVDEDKYLSIIPFTWVGCNNRSRTFASNRWLYDMMYLSLLGYQTDEYMEAVAGPVFGDVSLLHQTIDKVIDNTMGNLARANGTVHSGNGHQHESPNIGQVEDTLTRFTNSVLNHKDVLNSSSSDQDTLRREFRTFMHAHITQIEDNSRFSKQASSDAFSSPEQSYFQWVNSTGGSHVACAYSFAFSNCLMSANLLQGKDAFPSGTQKYLISSVMRHATNMCRMYNDFGSIARDNAERNVNSIHFPEFTLCNGTSQNLDERKERLLKIATYEQGYLDRALEALERQSRDDAGDRAGSKDMRKLKIVKLFCDVTDLYDQLYVIKDLSSSMK

SEQ ID NO: 245 - DNA, 1566 bp, Artificial Sequence
  Codon-optimized KO
aagcttactagtaaaatggacggtgtcatcgatatgcaaaccattccattgagaaccgctattgctattggtggtactgctgttgctttggttgttgcattatacttttggttcttgagatcctacgcttccccatctcatcattctaatcatttgccaccagtacctgaagttccaggtgttccagttttgggtaatttgttgcaattgaaagaaaaaaagccttacatgaccttcaccaagtgggctgaaatgtatggtccaatctactctattagaactggtgctacttccatggttgttgtctcttctaacgaaatcgccaaagaagttgttgttaccagattcccatctatctctaccagaaaattgtcttacgccttgaaggttttgaccgaagataagtctatggttgccatgtctgattatcacgattaccataagaccgtcaagagacatattttgactgctgttttgggtccaaacgcccaaaaaaagtttagagcacatagagacaccatgatggaaaacgtttccaatgaattgcatgccttcttcgaaaagaacccaaatcaagaagtcaacttgagaaagatcttccaatcccaattattcggtttggctatgaagcaagccttgggtaaagatgttgaatccatctacgttaaggatttggaaaccaccatgaagagagaagaaatcttcgaagttttggttgtcgatccaatgatgggtgctattgaagttgattggagagactttttcccatacttgaaatgggttccaaacaagtccttcgaaaacatcatccatagaatgtacactagaagagaagctgttatgaaggccttgatccaagaacacaagaaaagaattgcctccggtgaaaacttgaactcctacattgattacttgttgtctgaagcccaaaccttgaccgataagcaattattgatgtctttgtgggaacctattatcgaatcttctgataccactatggttactactgaatgggctatgtacgaattggctaagaatccaaacatgcaagacagattatacgaagaaatccaatccgtttgcggttccgaaaagattactgaagaaaacttgtcccaattgccatacttgtacgctgttttccaagaaactttgagaaagcactgtccagttcctattatgccattgagatatgttcacgaaaacaccgttttgggtggttatcatgttccagctggtactgaagttgctattaacatctacggttgcaacatggataagaaggtctgggaaaatccagaagaatggaatccagaaagattcttgtccgaaaaagaatccatggacttgtacaaaactatggcttttggtggtggtaaaagagtttgcgctggttctttacaagccatggttatttcttgcattggtatcggtagattggtccaagattttgaatggaagttgaaggatgatgccgaagaagatgttaacactttgggtttgactacccaaaagttgcatccattattggccttgattaacccaagaaagtaactcgagccgcgg

SEQ ID NO: 246 - protein, 512 aa, Lactuca sativa
MDGVIDMQTIPLRTAIAIGGTAVALVVALYFWFLRSYASPSHHSNHLPPVPEVPGVPVLGNLLQLKEKKPYMTFTKWAEMYGPIYSIRTGATSMVVVSSNEIAKEVVVTRFPSISTRKLSYALKVLTEDKSMVAMSDYHDYHKTVKRHILTAVLGPNAQKKFRAHRDTMMENVSNELHAFFEKNPNQEVNLRKIFQSQLFGLAMKQALGKDVESIYVKDLETTMKREEIFEVLVVDPMMGAIEVDWRDFFPYLKWVPNKSFENIIHRMYTRREAVMKALIQEHKKRIASGENLNSYIDYLLSEAQTLTDKQLLMSLWEPIIESSDTTMVTTEWAMYELAKNPNMQDRLYEEIQSVCGSEKITEENLSQLPYLYAVFQETLRKHCPVPIMPLRYVHENTVLGGYHVPAGTEVAINIYGCNMDKKVWENPEEWNPERFLSEKESMDLYKTMAFGGGKRVCAGSLQAMVISCIGIGRLVQDFEWKLKDDAEEDVNTLGLTTQKLHPLLALINPRK

SEQ ID NO: 247 - DNA, 1535 bp, Rubus suavissimus
atggccaccctccttgagcatttccaagctatgccctttgccatccctattgcactggctgctctgtcttggctgttcctcttttacatcaaagtttcattcttttccaacaagagtgctcaggctaagctccctcctgtgccagtggttcctgggctgccggtgattgggaatttactgcaactcaaggagaagaaaccctaccagacttttacaaggtgggctgaggagtatggaccaatctattctatcaggactggtgcttccaccatggtcgttctcaataccacccaagttgcaaaagaggccatggtgaccagatatttatccatctcaaccagaaagctatcaaacgcactaaagattcttactgctgataaatgtatggttgcaataagtgactacaacgattttcacaagatgataaagcgatacatactctcaaatgttcttggacctagtgctcagaagcgtcaccggagcaacagagataccttgagagctaatgtctgcagccgattgcattctcaagtaaagaactctcctcgagaagctgtgaatttcagaagagtttttgagtgggaactctttggaattgcattgaagcaagcctttggaaaggacatagaaaagcccatttatgtggaggaacttggcactacactgtcaagagatgagatctttaaggttctagtgcttgacataatggagggtgcaattgaggttgattggagagatttcttcccttacctgagatggattccgaatacgcgcatggaaacaaaaattcagcgactctatttccgcaggaaagcagtgatgactgccctgatcaacgagcagaagaagcgaattgcttcaggagaggaaatcaactgttatatcgacttcttgcttaaggaagggaagacactgacaatggaccaaataagtatgttgctttgggagacggttattgaaacagcagatactacaatggtaacgacagaatgggctatgtatgaagttgctaaagactcaaagcgtcaggatcgtctctatcaggaaatccaaaaggtttgtggatcggagatggttacagaggaatacttgtcccaactgccgtacctgaatgcagttttccatgaaacgctaaggaagcacagtccggctgcgttagttcctttaagatatgcacatgaagatacccaactaggaggttactacattccagctggaactgagattgctataaacatatacgggtgtaacatggacaagcatcaatgggaaagccctgaggaatggaaaccggagagatttttggacccgaaatttgatcctatggatttgtacaagaccatggcttttggggctggaaagagggtatgtgctggttctcttcaggcaatgttaatagcgtgcccgacgattggtaggctggtgcaggagtttgagtggaagctgagagatggagaagaagaaaatgtagatactgttgggctcaccactcacaaacgctatccaatgcatgcaatcctgaagccaagaagtta

SEQ ID NO: 248 - DNA, 1536 bp, Artificial Sequence; identical to SEQ ID NO: 205
  Codon-optimized KO

SEQ ID NO: 249 - protein, 511 aa, Rubus suavissimus; identical to SEQ ID NO: 206

SEQ ID NO: 250 - DNA, 1572 bp, Artificial Sequence
  Codon-optimized KO
aagcttactagtaaaatggcctccatcacccatttcttacaagattttcaagctactccattcgctactgcttttgctgttggtggtgtttctttgttgatattcttcttcttcatccgtggtttccactctactaagaaaaacgaatattacaagttgccaccagttccagttgttccaggtttgccagttgttggtaatttgttgcaattgaaagaaaagaagccatacaagactttcttgagatgggctgaaattcatggtccaatctactctattagaactggtgcttctaccatggttgttgttaactctactcatgttgccaaagaagctatggttaccagattctcttcaatctctaccagaaagttgtccaaggctttggaattattgacctccaacaaatctatggttgccacctctgattacaacgaatttcacaagatggtcaagaagtacatcttggccgaattattgggtgctaatgctcaaaagagacacagaattcatagagacaccttgatcgaaaacgtcttgaacaaattgcatgcccataccaagaattctccattgcaagctgttaacttcagaaagatcttcgaatctgaattattcggtttggctatgaagcaagccttgggttatgatgttgattccttgttcgttgaagaattgggtactaccttgtccagagaagaaatctacaacgttttggtcagtgacatgttgaagggtgctattgaagttgattggagagactttttcccatacttgaaatggatcccaaacaagtccttcgaaatgaagattcaaagattggcctctagaagacaagccgttatgaactctattgtcaaagaacaaaagaagtccattgcctctggtaagggtgaaaactgttacttgaattacttgttgtccgaagctaagactttgaccgaaaagcaaatttccattttggcctgggaaaccattattgaaactgctgatacaactgttgttaccactgaatgggctatgtacgaattggctaaaaacccaaagcaacaagacagattatacaacgaaatccaaaacgtctgcggtactgataagattaccgaagaacatttgtccaagttgccttacttgtctgctgtttttcacgaaaccttgagaaagtattctccatctccattggttccattgagatacgctcatgaagatactcaattgggtggttattatgttccagccggtactgaaattgctgttaatatctacggttgcaacatggacaagaatcaatgggaaactccagaagaatggaagccagaaagatttttggacgaaaagtacgatccaatggacatgtacaagactatgtcttttggttccggtaaaagagtttgcgctggttctttacaagctagtttgattgcttgtacctccatcggtagattggttcaagaatttgaatggagattgaaagacggtgaagttgaaaacgttgataccttgggtttgactacccataagttgtatccaatgcaagctatcttgcaacctagaaactgactcgagccgcgg

SEQ ID NO: 251 - protein, 514 aa, Castanea mollissima
MASITHFLQDFQATPFATAFAVGGVSLLIFFFFIRGFHSTKKNEYYKLPPVPVVPGLPVVGNLLQLKEKKPYKTFLRWAEIHGPIYSIRTGASTMVVVNSTHVAKEAMVTRFSSISTRKLSKALELLTSNKSMVATSDYNEFHKMVKKYILAELLGANAQKRHRIHRDTLIENVLNKLHAHTKNSPLQAVNFRKIFESELFGLAMKQALGYDVDSLFVEELGTTLSREEIYNVLVSDMLKGAIEVDWRDFFPYLKWIPNKSFEMKIQRLASRRQAVMNSIVKEQKKSIASGKGENCYLNYLLSEAKTLTEKQISILAWETIIETADTTVVTTEWAMYELAKNPKQQDRLYNEIQNVCGTDKITEEHLSKLPYLSAVFHETLRKYSPSPLVPLRYAHEDTQLGGYYVPAGTEIAVNIYGCNMDKNQWETPEEWKPERFLDEKYDPMDMYKTMSFGSGKRVCAGSLQASLIACTSIGRLVQEFEWRLKDGEVENVDTLGLTTHKLYPMQAILQPRN

SEQ ID NO: 252 - DNA, 1512 bp, Artificial Sequence
  Codon-optimized KO
atgatttccttgttgttgggttttgttgtctcctccttcttgtttatcttcttcttgaaaaaattgttgttcttcttcagtcgtcacaaaatgtccgaagtttctagattgccatctgttccagttccaggttttccattgattggtaacttgttgcaattgaaagaaaagaagccacacaagactttcaccaagtggtctgaattatatggtccaatctactctatcaagatgggttcctcttctttgatcgtcttgaactctattgaaaccgccaaagaagctatggtcagtagattctcttcaatctctaccagaaagttgtctaacgctttgactgttttgacctgcaacaaatctatggttgctacctctgattacgatgactttcataagttcgtcaagagatgcttgttgaacggtttgttgggtgctaatgctcaagaaagaaaaagacattacagagatgccttgatcgaaaacgttacctctaaattgcatgcccataccagaaatcatccacaagaaccagttaacttcagagccattttcgaacacgaattattcggtgttgctttgaaacaagccttcggtaaagatgtcgaatccatctatgtaaaagaattgggtgtcaccttgtccagagatgaaattttcaaggttttggtccacgacatgatggaaggtgctattgatgttgattggagagatttcttcccatacttgaaatggatcccaaacaactctttcgaagccagaattcaacaaaagcacaagagaagattggctgttatgaacgccttgatccaagacagattgaatcaaaacgattccgaatccgatgatgactgctacttgaatttcttgatgtctgaagctaagaccttgaccatggaacaaattgctattttggtttgggaaaccattatcgaaactgctgataccactttggttactactgaatgggctatgtacgaattggccaaacatcaatctgttcaagatagattattcaaagaaatccaatccgtctgcggtggtgaaaagatcaaagaagaacaattgccaagattgccttacgtcaatggtgtttttcacgaaaccttgagaaagtattctccagctccattggttccaattagatacgctcatgaagatacccaaattggtggttatcatattccagccggttctgaaattgccattaacatctacggttgcaacatggataagaagagatgggaaagacctgaagaatggtggccagaaagatttttggaagatagatacgaatcctccgacttgcataagactatggcttttggtgctggtaaaagagtttgtgctggtgctttacaagctagtttgatggctggtattgctatcggtagattggttcaagaattcgaatggaagttgagagatggtgaagaagaaaacgttgatacttacggtttgacctcccaaaagttgtatccattgatggccattatcaacccaagaagatcttaa

SEQ ID NO: 253 - protein, 506 aa, Thellungiella halophila
MASMISLLLGFVVSSFLFIFFLKKLLFFFSRHKMSEVSRLPSVPVPGFPLIGNLLQLKEKKPHKTFTKWSELYGPIYSIKMGSSSLIVLNSIETAKEAMVSRFSSISTRKLSNALTVLTCNKSMVATSDYDDFHKFVKRCLLNGLLGANAQERKRHYRDALIENVTSKLHAHTRNHPQEPVNFRAIFEHELFGVALKQAFGKDVESIYVKELGVTLSRDEIFKVLVHDMMEGAIDVDWRDFFPYLKWIPNNSFEARIQQKHKRRLAVMNALIQDRLNQNDSESDDDCYLNFLMSEAKTLTMEQIAILVWETIIETADTTLVTTEWAMYELAKHQSVQDRLFKEIQSVCGGEKIKEEQLPRLPYVNGVFHETLRKYSPAPLVPIRYAHEDTQIGGYHIPAGSEIAINIYGCNMDKKRWERPEEWWPERFLEDRYESSDLHKTMAFGAGKRVCAGALQASLMAGIAIGRLVQEFEWKLRDGEEENVDTYGLTSQKLYPLMAIINPRRS

SEQ ID NO: 254 - DNA, 1554 bp, Artificial Sequence
  Codon-optimized KO
aagcttactagtaaaatggacatgatgggtattgaagctgttccatttgctactgctgttgttttgggtggtatttccttggttgttttgatcttcatcagaagattcgtttccaacagaaagagatccgttgaaggtttgccaccagttccagatattccaggtttaccattgattggtaacttgttgcaattgaaagaaaagaagccacataagacctttgctagatgggctgaaacttacggtccaattttctctattagaactggtgcttctaccatgatcgtcttgaattcttctgaagttgccaaagaagctatggtcactagattctcttcaatctctaccagaaagttgtccaacgccttgaagattttgaccttcgataagtgtatggttgccacctctgattacaacgattttcacaaaatggtcaagggtttcatcttgagaaacgttttaggtgctccagcccaaaaaagacatagatgtcatagagataccttgatcgaaaacatctctaagtacttgcatgcccatgttaagacttctccattggaaccagttgtcttgaagaagattttcgaatccgaaattttcggtttggctttgaaacaagccttgggtaaggatatcgaatccatctatgttgaagaattgggtactaccttgtccagagaagaaatttttgccgttttggttgttgatccaatggctggtgctattgaagttgattggagagattttttcccatacttgtcctggattccaaacaagtctatggaaatgaagatccaaagaatggattttagaagaggtgctttgatgaaggccttgattggtgaacaaaagaaaagaatcggttccggtgaagaaaagaactcctacattgatttcttgttgtctgaagctaccactttgaccgaaaagcaaattgctatgttgatctgggaaaccatcatcgaaatttccgatacaactttggttacctctgaatgggctatgtacgaattggctaaagacccaaatagacaagaaatcttgtacagagaaatccacaaggtttgcggttctaacaagttgactgaagaaaacttgtccaagttgccatacttgaactctgttttccacgaaaccttgagaaagtattctccagctccaatggttccagttagatatgctcatgaagatactcaattgggtggttaccatattccagctggttctcaaattgccattaacatctacggttgcaacatgaacaaaaagcaatgggaaaatcctgaagaatggaagccagaaagattcttggacgaaaagtatgacttgatggacttgcataagactatggcttttggtggtggtaaaagagtttgtgctggtgctttacaagcaatgttgattgcttgcacttccatcggtagattcgttcaagaatttgaatggaagttgatgggtggtgaagaagaaaacgttgatactgttgctttgacctcccaaaaattgcatccaatgcaagccattattaaggccagagaatgactcgagccgcgg

SEQ ID NO: 255 - protein, 508 aa, Vitis vinifera
MDMMGIEAVPFATAVVLGGISLVVLIFIRRFVSNRKRSVEGLPPVPDIPGLPLIGNLLQLKEKKPHKTFARWAETYGPIFSIRTGASTMIVLNSSEVAKEAMVTRFSSISTRKLSNALKILTFDKCMVATSDYNDFHKMVKGFILRNVLGAPAQKRHRCHRDTLIENISKYLHAHVKTSPLEPVVLKKIFESEIFGLALKQALGKDIESIYVEELGTTLSREEIFAVLVVDPMAGAIEVDWRDFFPYLSWIPNKSMEMKIQRMDFRRGALMKALIGEQKKRIGSGEEKNSYIDFLLSEATTLTEKQIAMLIWETIIEISDTTLVTSEWAMYELAKDPNRQEILYREIHKVCGSNKLTEENLSKLPYLNSVFHETLRKYSPAPMVPVRYAHEDTQLGGYHIPAGSQIAINIYGCNMNKKQWENPEEWKPERFLDEKYDLMDLHKTMAFGGGKRVCAGALQAMLIACTSIGRFVQEFEWKLMGGEEENVDTVALTSQKLHPMQAIIKARE

SEQ ID NO: 256 - DNA, 1593 bp, Artificial Sequence
  Codon-optimized KO
aagcttaaaatgagtaagtctaatagtatgaattctacatcacacgaaaccctttttcaacaattggtcttgggtttggaccgtatgccattgatggatgttcactggttgatctacgttgctttcggcgcatggttatgttcttatgtgatacatgttttatcatcttcctctacagtaaaagtgccagttgttggatacaggtctgtattcgaacctacatggttgcttagacttagattcgtctgggaaggtggctctatcataggtcaagggtacaataagtttaaagactctattttccaagttaggaaattgggaactgatattgtcattataccacctaactatattgatgaagtgagaaaattgtcacaggacaagactagatcagttgaacctttcattaatgattttgcaggtcaatacacaagaggcatggttttcttgcaatctgacttacaaaaccgtgttatacaacaaagactaactccaaaattggtttccttgaccaaggtcatgaaggaagagttggattatgctttaacaaaagagatgcctgatatgaaaaatgacgaatgggtagaagtagatatcagtagtataatggtgagattgatttccaggatctccgccagagtctttctagggcctgaacactgtcgtaaccaggaatggttgactactacagcagaatattcagaatcacttttcattacagggtttatcttaagagttgtacctcatatcttaagaccattcatcgcccctctattaccttcatacaggactctacttagaaacgtttcaagtggtagaagagtcatcggtgacatcataagatctcagcaaggggatggtaacgaagatatactttcctggatgagagatgctgccacaggagaggaaaagcaaatcgataacattgctcagagaatgttaattctttctttagcatcaatccacactactgcgatgaccatgacacatgccatgtacgatctatgtgcttgccctgagtacattgaaccattaagagatgaagttaaatctgttgttggggcttctggctgggacaagacagcgttaaacagatttcataagttggactccttcctaaaagagtcacaaagattcaacccagtattcttattgacattcaatagaatctaccatcaatctatgaccttatcagatggcactaacattccatctggaacacgtattgctgttccatcacacgcaatgttgcaagattctgcacatgtcccaggtccaaccccacctactgaatttgatggattcagatatagtaagatacgttctgatagtaactacgcacaaaagtacctattctccatgaccgattcttcaaacatggctttcggatacggcaagtatgcttgtccaggtagattttacgcgtctaatgagatgaaactaacattagccattttgttgctacaatttgagttcaaactaccagatggtaaaggtcgtcctagaaatatcactatcgattctgatatgattccagacccaagagctagactttgcgtcagaaaaagatcacttagagatgaatgaccgcgg

SEQ ID NO: 257 - protein, 525 aa, Gibberella fujikuroi
MSKSNSMNSTSHETLFQQLVLGLDRMPLMDVHWLIYVAFGAWLCSYVIHVLSSSSTVKVPVVGYRSVFEPTWLLRLRFVWEGGSIIGQGYNKFKDSIFQVRKLGTDIVIIPPNYIDEVRKLSQDKTRSVEPFINDFAGQYTRGMVFLQSDLQNRVIQQRLTPKLVSLTKVMKEELDYALTKEMPDMKNDEWVEVDISSIMVRLISRISARVFLGPEHCRNQEWLTTTAEYSESLFITGFILRVVPHILRPFIAPLLPSYRTLLRNVSSGRRVIGDIIRSQQGDGNEDILSWMRDAATGEEKQIDNIAQRMLILSLASIHTTAMTMTHAMYDLCACPEYIEPLRDEVKSVVGASGWDKTALNRFHKLDSFLKESQRFNPVFLLTFNRIYHQSMTLSDGTNIPSGTRIAVPSHAMLQDSAHVPGPTPPTEFDGFRYSKIRSDSNYAQKYLFSMTDSSNMAFGYGKYACPGRFYASNEMKLTLAILLLQFEFKLPDGKGRPRNITIDSDMIPDPRARLCVRKRSLRDE

SEQ ID NO: 258 - DNA, 1515 bp, Artificial Sequence
  Codon-optimized KO
aagcttaaaatggaagatcctactgtcttatatgcttgtcttgccattgcagttgcaactttcgttgttagatggtacagagatccattgagatccatcccaacagttggtggttccgatttgcctattctatcttacatcggcgcactaagatggacaagacgtggcagagagatacttcaagagggatatgatggctacagaggatctacattcaaaatcgcgatgttagaccgttggatcgtgatcgcaaatggtcctaaactagctgatgaagtcagacgtagaccagatgaagagttaaactttatggacggattaggagcattcgtccaaactaagtacaccttaggtgaagctattcataacgatccataccatgtcgatatcataagagaaaaactaacaagaggccttccagccgtgcttcctgatgtcattgaagagttgacacttgcggttagacagtacattccaacagaaggtgatgaatgggtgtccgtaaactgttcaaaggccgcaagagatattgttgctagagcttctaatagagtctttgtaggtttgcctgcttgcagaaaccaaggttacttagatttggcaatagactttacattgtctgttgtcaaggatagagccatcatcaatatgtttccagaattgttgaagccaatagttggcagagttgtaggtaacgccaccagaaatgttcgtagagctgttccttttgttgctccattggtggaggaaagacgtagacttatggaagagtacggtgaagactggtctgaaaaacctaatgatatgttacagtggataatggatgaagctgcatccagagatagttcagtgaaggcaatcgcagagagattgttaatggtgaacttcgcggctattcatacctcatcaaacactatcactcatgctttgtaccaccttgccgaaatgcctgaaactttgcaaccacttagagaagagatcgaaccattagtcaaagaggagggctggaccaaggctgctatgggaaaaatgtggtggttagattcatttctaagagaatctcaaagatacaatggcattaacatcgtatctttaactagaatggctgacaaagatattacattgagtgatggcacatttttgccaaaaggtactctagtggccgttccagcgtattctactcatagagatgatgctgtctacgctgatgccttagtattcgatcctttcagattctcacgtatgagagcgagagaaggtgaaggtacaaagcaccagttcgttaatacttcagtcgagtacgttccatttggtcacggaaagcatgcttgtccaggaagattcttcgccgcaaacgaattgaaagcaatgttggcttacattgttctaaactatgatgtaaagttgcctggtgacggtaaacgtccattgaacatgtattggggtccaacagttttgcctgcaccagcaggccaagtattgttcagaaagagacaagttagtctataaccgcgg

SEQ ID NO: 259 - protein, 499 aa, Trametes versicolor
MEDPTVLYACLAIAVATFVVRWYRDPLRSIPTVGGSDLPILSYIGALRWTRRGREILQEGYDGYRGSTFKIAMLDRWIVIANGPKLADEVRRRPDEELNFMDGLGAFVQTKYTLGEAIHNDPYHVDIIREKLTRGLPAVLPDVIEELTLAVRQYIPTEGDEWVSVNCSKAARDIVARASNRVFVGLPACRNQGYLDLAIDFTLSVVKDRAIINMFPELLKPIVGRVVGNATRNVRRAVPFVAPLVEERRRLMEEYGEDWSEKPNDMLQWIMDEAASRDSSVKAIAERLLMVNFAAIHTSSNTITHALYHLAEMPETLQPLREEIEPLVKEEGWTKAAMGKMWWLDSFLRESQRYNGINIVSLTRMADKDITLSDGTFLPKGTLVAVPAYSTHRDDAVYADALVFDPFRFSRMRAREGEGTKHQFVNTSVEYVPFGHGKHACPGRFFAANELKAMLAYIVLNYDVKLPGDGKRPLNMYWGPTVLPAPAGQVLFRKRQVSL

SEQ ID NO: 260 - DNA, 1530 bp, Artificial Sequence
  Codon-optimized KO
atggcatttttctctatgatttcaattttgttgggatttgttatttcttctttcatcttcatctttttcttcaaaaagttacttagttttagtaggaaaaacatgtcagaagtttctactttgccaagtgttccagtagtgcctggttttccagttattgggaatttgttgcaactaaaggagaaaaagcctcataaaactttcactagatggtcagagatatatggacctatctactctataaagatgggttcttcatctcttattgtattgaacagtacagaaactgctaaggaagcaatggtcactagattttcatcaatatctaccagaaaattgtcaaacgccctaacagttctaacctgcgataagtctatggtcgccacttctgattatgatgacttccacaaattagttaagagatgtttgctaaatggacttcttggtgctaatgctcaaaagagaaaaagacactacagagatgctttgattgaaaatgtgagttccaagctacatgcacacgctagagatcatccacaagagccagttaactttagagcaattttcgaacacgaattgtttggtgtagcattaaagcaagccttcggtaaagacgtagaatccatatacgtcaaggagttaggcgtaacattatcaaaagatgaaatctttaaggtgcttgtacatgatatgatggagggtgcaattgatgtagattggagagatttcttcccatatttgaaatggatccctaataagtcttttgaagctaggatacaacaaaagcacaagagaagactagctgttatgaacgcacttatacaggacagattgaagcaaaatgggtctgaatcagatgatgattgttaccttaacttcttaatgtctgaggctaaaacattgactaaggaacagatcgcaatccttgtctgggaaacaatcattgaaacagcagatactaccttagtcacaactgaatgggccatatacgagctagccaaacatccatctgtgcaagataggttgtgtaaggagatccagaacgtgtgtggtggagagaaattcaaggaagagcagttgtcacaagttccttaccttaacggcgttttccatgaaaccttgagaaaatactcacctgcaccattagttcctattagatacgcccacgaagatacacaaatcggtggctaccatgttccagctgggtccgaaattgctataaacatctacgggtgcaacatggacaaaaagagatgggaaagaccagaagattggtggccagaaagattcttagatgatggcaaatatgaaacatctgatttgcataaaacaatggctttcggagctggcaaaagagtgtgtgccggtgctctacaagcctccctaatggctggtatcgctattggtagattggtccaagagttcgaatggaaacttagagatggtgaagaggaaaatgtcgatacttatgggttaacatctcaaaagttatacccactaatggcaatcatcaatcctagaagatcctaa

SEQ ID NO: 261 - protein, 509 aa, Arabidopsis thaliana
MAFFSMISILLGFVISSFIFIFFFKKLLSFSRKNMSEVSTLPSVPVVPGFPVIGNLLQLKEKKPHKTFTRWSEIYGPIYSIKMGSSSLIVLNSTETAKEAMVTRFSSISTRKLSNALTVLTCDKSMVATSDYDDFHKLVKRCLLNGLLGANAQKRKRHYRDALIENVSSKLHAHARDHPQEPVNFRAIFEHELFGVALKQAFGKDVESIYVKELGVTLSKDEIFKVLVHDMMEGAIDVDWRDFFPYLKWIPNKSFEARIQQKHKRRLAVMNALIQDRLKQNGSESDDDCYLNFLMSEAKTLTKEQIAILVWETIIETADTTLVTTEWAIYELAKHPSVQDRLCKEIQNVCGGEKFKEEQLSQVPYLNGVFHETLRKYSPAPLVPIRYAHEDTQIGGYHVPAGSEIAINIYGCNMDKKRWERPEDWWPERFLDDGKYETSDLHKTMAFGAGKRVCAGALQASLMAGIAIGRLVQEFEWKLRDGEEENVDTYGLTSQKLYPLMAIINPRRS

SEQ ID NO: 262 - DNA, 2133 bp, Artificial Sequence
  Codon-optimized CPR
atgcaatcagattcagtcaaagtctctccatttgatttggtttccgctgctatgaatggcaaggcaatggaaaagttgaacgctagtgaatctgaagatccaacaacattgcctgcactaaagatgctagttgaaaatagagaattgttgacactgttcacaacttccttcgcagttcttattgggtgtcttgtatttctaatgtggagacgttcatcctctaaaaagctggtacaagatccagttccacaagttatcgttgtaaagaagaaagagaaggagtcagaggttgatgacgggaaaaagaaagtttctattttctacggcacacaaacaggaactgccgaaggttttgctaaagcattagtcgaggaagcaaaagtgagatatgaaaagacctctttcaaggttatcgatctagatgactacgctgcagatgatgatgaatatgaggaaaaactgaaaaaggaatccttagccttcttcttcttggccacatacggtgatggtgaacctactgataatgctgctaacttctacaagtggttcacagaaggcgacgataaaggtgaatggctgaaaaagttacaatacggagtatttggtttaggtaacagacaatatgaacatttcaacaagatcgctattgtagttgatgataaacttactgaaatgggagccaaaagattagtaccagtaggattaggggatgatgatcagtgtatagaagatgacttcaccgcctggaaggaattggtatggccagaattggatcaacttttaagggacgaagatgatacttctgtgactaccccatacactgcagccgtattggagtacagagtggtttaccatgataaaccagcagactcatatgctgaagatcaaacccatacaaacggtcatgttgttcatgatgcacagcatccttcaagatctaatgtggctttcaaaaaggaactacacacctctcaatcagataggtcttgtactcacttagaattcgatatttctcacacaggactgtcttacgaaactggcgatcacgttggcgtttattccgagaacttgtccgaagttgtcgatgaagcactaaaactgttagggttatcaccagacacatacttctcagtccatgctgataaggaggatgggacacctatcggtggtgcttcactaccaccaccttttcctccttgcacattgagagacgctctaaccagatacgcagatgtcttatcctcacctaaaaaggtagctttgctggcattggctgctcatgctagtgatcctagtgaagccgataggttaaagttcctggcttcaccagccggaaaagatgaatatgcacaatggatcgtcgccaaccaacgttctttgctagaagtgatgcaaagttttccatctgccaagcctccattaggtgtgttcttcgcagcagtagctccacgtttacaaccaagatactactctatcagttcatctcctaagatgtctcctaacagaatacatgttacatgtgctttggtgtacgagactactccagcaggcagaattcacagaggattgtgttcaacctggatgaaaaatgctgtccctttaacagagtcacctgattgctctcaagcatccattttcgttagaacatcaaatttcagacttccagtggatccaaaagttccagtcattatgataggaccaggcactggtcttgccccattcaggggctttcttcaagagagattggccttgaaggaatctggtacagaattgggttcttctatctttttctttggttgccgtaatagaaaagttgactttatctacgaggacgagcttaacaattttgttgagacaggagcattgtcagaattgatcgtcgcattttcaagagaagggactgccaaagagtacgttcagcacaagatgagtcaaaaagcctccgatatatggaaacttctaagtgaaggtgcctatctttatgtctgtggcgatgcaaagggcatggccaaggatgtccatagaactctgcatacaattgttcaggaacaagggagtctggattcttccaaggctgaattgtacgtcaaaaacttacagatgtctggaagatacttaagagatgtttggtaa

SEQ ID NO: 263 - protein, 710 aa, Stevia rebaudiana
MQSDSVKVSPFDLVSAAMNGKAMEKLNASESEDPTTLPALKMLVENRELLTLFTTSFAVLIGCLVFLMWRRSSSKKLVQDPVPQVIVVKKKEKESEVDDGKKKVSIFYGTQTGTAEGFAKALVEEAKVRYEKTSFKVIDLDDYAADDDEYEEKLKKESLAFFFLATYGDGEPTDNAANFYKWFTEGDDKGEWLKKLQYGVFGLGNRQYEHFNKIAIVVDDKLTEMGAKRLVPVGLGDDDQCIEDDFTAWKELVWPELDQLLRDEDDTSVTTPYTAAVLEYRVVYHDKPADSYAEDQTHTNGHVVHDAQHPSRSNVAFKKELHTSQSDRSCTHLEFDISHTGLSYETGDHVGVYSENLSEVVDEALKLLGLSPDTYFSVHADKEDGTPIGGASLPPPFPPCTLRDALTRYADVLSSPKKVALLALAAHASDPSEADRLKFLASPAGKDEYAQWIVANQRSLLEVMQSFPSAKPPLGVFFAAVAPRLQPRYYSISSSPKMSPNRIHVTCALVYETTPAGRIHRGLCSTWMKNAVPLTESPDCSQASIFVRTSNFRLPVDPKVPVIMIGPGTGLAPFRGFLQERLALKESGTELGSSIFFFGCRNRKVDFIYEDELNNFVETGALSELIVAFSREGTAKEYVQHKMSQKASDIWKLLSEGAYLYVCGDAKGMAKDVHRTLHTIVQEQGSLDSSKAELYVKNLQMSGRYLRDVW

SEQ ID NO: 264 - DNA, 2106 bp, Siraitia grosvenorii
atgaaggtcagtccattcgaattcatgtccgctattatcaagggtagaatggacccatctaactcctcatttgaatctactggtgaagttgcctccgttatctttgaaaacagagaattggttgccatcttgaccacttctattgctgttatgattggttgcttcgttgtcttgatgtggagaagagctggttctagaaaggttaagaatgtcgaattgccaaagccattgattgtccatgaaccagaacctgaagttgaagatggtaagaagaaggtttccatcttcttcggtactcaaactggtactgctgaaggttttgctaaggctttggctgatgaagctaaagctagatacgaaaaggctaccttcagagttgttgatttggatgattatgctgccgatgatgaccaatacgaagaaaaattgaagaacgaatccttcgccgttttcttgttggctacttatggtgatggtgaacctactgataatgctgctagattttacaagtggttcgccgaaggtaaagaaagaggtgaatggttgcaaaacttgcactatgctgtttttggtttgggtaacagacaatacgaacacttcaacaagattgctaaggttgccgacgaattattggaagctcaaggtggtaatagattggttaaggttggtttaggtgatgacgatcaatgcatcgaagatgatttttctgcttggagagaatctttgtggccagaattggatatgttgttgagagatgaagatgatgctactactgttactactccatatactgctgctgtcttggaatacagagttgtctttcatgattctgctgatgttgctgctgaagataagtcttggattaacgctaatggtcatgctgttcatgatgctcaacatccattcagatctaacgttgtcgtcagaaaagaattgcatacttctgcctctgatagatcctgttctcatttggaattcaacatttccggttccgctttgaattacgaaactggtgatcatgttggtgtctactgtgaaaacttgactgaaactgttgatgaagccttgaacttgttgggtttgtctccagaaacttacttctctatctacaccgataacgaagatggtactccattgggtggttcttcattgccaccaccatttccatcatgtactttgagaactgctttgaccagatacgctgatttgttgaactctccaaaaaagtctgctttgttggctttagctgctcatgcttctaatccagttgaagctgatagattgagatacttggcttctccagctggtaaagatgaatatgcccaatctgttatcggttcccaaaagtctttgttggaagttatggctgaattcccatctgctaaaccaccattaggtgttttttttgctgctgttgctccaagattgcaacctagattctactccatttcatcctctccaagaatggctccatctagaatccatgttacttgtgctttggtttacgataagatgccaactggtagaattcataagggtgtttgttctacctggatgaagaattctgttccaatggaaaagtcccatgaatgttcttgggctccaattttcgttagacaatccaattttaagttgccagccgaatccaaggttccaattatcatggttggtccaggtactggtttggctccttttagaggttttttacaagaaagattggccttgaaagaatccggtgttgaattgggtccatccattttgtttttcggttgcagaaacagaagaatggattacatctacgaagatgaattgaacaacttcgttgaaaccggtgctttgtccgaattggttattgctttttctagagaaggtcctaccaaagaatacgtccaacataagatggctgaaaaggcttctgatatctggaacttgatttctgaaggtgcttacttgtacgtttgtggtgatgctaaaggtatggctaaggatgttcatagaaccttgcataccatcatgcaagaacaaggttctttggattcttccaaagctgaatccatggtcaagaacttgcaaatgaatggtagatacttaagagatgtttggtaa

SEQ ID NO: 265 - protein, 701 aa, Siraitia grosvenorii
MKVSPFEFMSAIIKGRMDPSNSSFESTGEVASVIFENRELVAILTTSIAVMIGCFVVLMWRRAGSRKVKNVELPKPLIVHEPEPEVEDGKKKVSIFFGTQTGTAEGFAKALADEAKARYEKATFRVVDLDDYAADDDQYEEKLKNESFAVFLLATYGDGEPTDNAARFYKWFAEGKERGEWLQNLHYAVFGLGNRQYEHFNKIAKVADELLEAQGGNRLVKVGLGDDDQCIEDDFSAWRESLWPELDMLLRDEDDATTVTTPYTAAVLEYRVVFHDSADVAAEDKSWINANGHAVHDAQHPFRSNVVVRKELHTSASDRSCSHLEFNISGSALNYETGDHVGVYCENLTETVDEALNLLGLSPETYFSIYTDNEDGTPLGGSSLPPPFPSCTLRTALTRYADLLNSPKKSALLALAAHASNPVEADRLRYLASPAGKDEYAQSVIGSQKSLLEVMAEFPSAKPPLGVFFAAVAPRLQPRFYSISSSPRMAPSRIHVTCALVYDKMPTGRIHKGVCSTWMKNSVPMEKSHECSWAPIFVRQSNFKLPAESKVPIIMVGPGTGLAPFRGFLQERLALKESGVELGPSILFFGCRNRRMDYIYEDELNNFVETGALSELVIAFSREGPTKEYVQHKMAEKASDIWNLISEGAYLYVCGDAKGMAKDVHRTLHTIMQEQGSLDSSKAESMVKNLQMNGRYLRDVW

SEQ ID NO: 266 - protein, 523 aa, Rubus suavissimus
MEVTVASSVALSLVFISIVVRWAWSVVNWVWFKPKKLERFLREQGLKGNSYRFLYGDMKENSILLKQARSKPMNLSTSHDIAPQVTPFVDQTVKAYGKNSFNWVGPIPRVNIMNPEDLKDVLTKNVDFVKPISNPLIKLLATGIAIYEGEKWTKHRRIINPTFHSERLKRMLPSFHQSCNEMVKEWESLVSKEGSSCELDVWPFLENMSADVISRTAFGTSYKKGQKIFELLREQVIYVTKGFQSFYIPGWRFLPTKMNKRMNEINEEIKGLIRGIIIDREQIIKAGEETNDDLLGALMESNLKDIREHGKNNKNVGMSIEDVIQECKLFYFAGQETTSVLLAWTMVLLGQNQNWQDRARQEVLQVFGSSKPDFDGLAHLKVVTMILLEVLRLYPPVIELIRTIHKKTQLGKLSLPEGVEVRLPTLLIHHDKELWGDDANQFNPERFSEGVSKATKNRLSFFPFGAGPRICIGQNFSMMEAKLALALILQHFTFELSPSHAHAPSHRITLQPQYGVRIILHRR

SEQ ID NO: 267 - DNA, 1566 bp, Prunus avium
atggaagcatcaagggctagttgtgttgcgctatgtgttgtttgggtgagcatagtaattacattggcatggagggtgctgaattgggtgtggttgaggccaaagaaactagaaagatgcttgagggagcaaggccttacaggcaattcttacaggcttttgtttggagacaccaaggatctctcgaagatgctggaacaaacacaatccaaacccatcaaactctccacctcccatgatatagcgccacgagtcaccccatttttccatcgaactgtgaactctaatggcaagaattcttttgtttggatgggccctataccaagagtgcacatcatgaatccagaagatttgaaagatgccttcaacagacatgatgattttcataagacagtaaaaaatcctatcatgaagtctccaccaccgggcattgtaggcattgaaggtgagcaatgggctaaacacagaaagattatcaacccagcattccatttagagaagctaaagggtatggtaccaatattttaccaaagttgtagcgagatgattaacaaatgggagagcttggtgtccaaagagagttcatgtgagttggatgtgtggccttatcttgaaaattttaccagcgatgtgatttcccgagctgcatttggaagtagctatgaagagggaaggaaaatatttcaactactaagagaggaagcaaaagtttattcggtagctctacgaagtgtttacattccaggatggaggtttctaccaaccaagcagaacaagaagacgaaggaaattcacaatgaaattaaaggcttacttaagggcattataaataaaagggaagaggcgatgaaggcaggggaagccactaaagatgacttactaggaatacttatggagtccaacttcagggaaattcaggaacatgggaacaacaaaaatgctggaatgagtattgaagatgtaattggagagtgtaagttgttttactttgctgggcaagagaccacttcggtgttgcttgtttggacaatgattttactaagccaaaatcaggattggcaagctcgtgcaagagaagaggtcttgaaagtctttggaagcaacatcccaacctatgaagagctaagtcacctaaaagttgtgaccatgattttacttgaagttcttcgattatacccatcagtcgttgcgcttcctcgaaccactcacaagaaaacacagcttggaaaattatcattaccagctggagtggaagtctccttgcccatactgcttgttcaccatgacaaagagttgtggggtgaggatgcaaatgagttcaagccagagaggttttcagagggagtttcaaaggcaacaaagaacaaatttacatacttacctttcggagggggtccaaggatttgcattggacaaaactttgccatggtggaagctaaattggccttggccctgattttacaacactttgcctttgagctttctccatcctatgctcatgctccttctgcagttataacccttcaacctcaatttggtgctcatatcattttgcataaacgttga

SEQ ID NO: 268 - DNA, 1567 bp, Artificial Sequence
  Codon-optimized KAH
atggaagcttctagagcatcttgtgttgctttgtgtgttgtttgggtttccatcgttattactttggcttggagagttttgaattgggtctggttaagaccaaaaaagttggaaagatgcttgagagaacaaggtttgactggtaactcttacagattgttgttcggtgataccaaggacttgtctaagatgttggaacaaactcaatccaagcctatcaagttgtctacctctcatgatattgctccaagagttactccattcttccatagaactgttaactccaacggtaagaactcttttgtttggatgggtccaattccaagagtccatattatgaaccctgaagatttgaaggacgctttcaacagacatgatgatttccataagaccgtcaagaacccaattatgaagtctccaccaccaggtatagttggtattgaaggtgaacaatgggccaaacatagaaagattattaacccagccttccacttggaaaagttgaaaggtatggttccaatcttctaccaatcctgctctgaaatgattaacaagtgggaatccttggtttccaaagaatcttcctgtgaattggatgtctggccatatttggaaaacttcacctccgatgttatttccagagctgcttttggttcttcttacgaagaaggtagaaagatcttccaattattgagagaagaagccaaggtttactccgttgctttgagatctgtttacattccaggttggagattcttgccaactaagcaaaacaaaaagaccaaagaaatccacaacgaaatcaagggtttgttgaagggtatcatcaacaagagagaagaagctatgaaggctggtgaagctacaaaagatgatttgttgggtatcttgatggaatccaacttcagagaaatccaagaacacggtaacaacaagaatgccggtatgtctattgaagatgttatcggtgaatgcaagttgttctactttgctggtcaagaaactacctccgttttgttggtttggaccatgattttgttgtcccaaaatcaagattggcaagctagagctagagaagaagtcttgaaagttttcggttctaacatcccaacctacgaagaattgtctcacttgaaggttgtcactatgatcttgttggaagtattgagattatacccatccgttgttgcattgccaagaactactcataagaaaactcaattgggtaaattgtccttgccagctggtgttgaagtttctttgccaattttgttagtccaccacgacaaagaattgtggggtgaagatgctaatgaattcaagccagaaagattctccgaaggtgtttctaaagctaccaagaacaagttcacttacttgccatttggtggtggtccaagaatatgtattggtcaaaatttcgctatggtcgaagctaaattggctttggctttgatcttgcaacatttcgctttcgaattgtcaccatcttatgctcatgctccatctgctgttattacattgcaaccacaatttggtgcccatatcatcttgcataagagataac

SEQ ID NO: 269 - protein, 521 aa, Prunus avium
MEASRASCVALCVVWVSIVITLAWRVLNWVWLRPKKLERCLREQGLTGNSYRLLFGDTKDLSKMLEQTQSKPIKLSTSHDIAPRVTPFFHRTVNSNGKNSFVWMGPIPRVHIMNPEDLKDAFNRHDDFHKTVKNPIMKSPPPGIVGIEGEQWAKHRKIINPAFHLEKLKGMVPIFYQSCSEMINKWESLVSKESSCELDVWPYLENFTSDVISRAAFGSSYEEGRKIFQLLREEAKVYSVALRSVYIPGWRFLPTKQNKKTKEIHNEIKGLLKGIINKREEAMKAGEATKDDLLGILMESNFREIQEHGNNKNAGMSIEDVIGECKLFYFAGQETTSVLLVWTMILLSQNQDWQARAREEVLKVFGSNIPTYEELSHLKVVTMILLEVLRLYPSVVALPRTTHKKTQLGKLSLPAGVEVSLPILLVHHDKELWGEDANEFKPERFSEGVSKATKNKFTYLPFGGGPRICIGQNFAMVEAKLALALILQHFAFELSPSYAHAPSAVITLQPQFGAHIILHKR

SEQ ID NO: 270 - protein, 517 aa, Prunus mume
ASWVAVLSVVWVSMVIAWAWRVLNWVWLRPKKLEKCLREQGLAGNSYRLLFGDTKDLSKMLEQTQSKPIKLSTSHDIAPHVTPFFHQTVNSYGKNSFVWMGPIPRVHIMNPEDLKDTFNRHDDFHKVVKNPIMKSLPQGIVGIEGEQWAKHRKIINPAFHLEKLKGMVPIFYRSCSEMINKWESLVSKESSCELDVWPYLENFTSDVISRAAFGSSYEEGRKIFQLLREEAKIYTVAMRSVYIPGWRFLPTKQNKKAKEIHNEIKGLLKGIINKREEAMKAGEATKDDLLGILMESNFREIQEHGNNKNAGMSIEDVIGECKLFYFAGQETTSVLLVWTMVLLSQNQDWQARAREEVLQVFGSNIPTYEELSQLKVVTMILLEVLRLYPSVVALPRTTHKKTQLGKLSLPAGVEVSLPILLVHHDKELWGEDANEFKPERFSEGVSKATKNQFTYFPFGGGPRICIGQNFAMMEAKLALSLILRHFALELSPLYAHAPSVTITLQPQYGAHIILHKR

SEQ ID NO: 271 - protein, 521 aa, Prunus mume
MEASRPSCVALSVVLVSIVIAWAWRVLNWVWLRPNKLERCLREQGLTGNSYRLLFGDTKEISMMVEQAQSKPIKLSTTHDIAPRVIPFSHQIVYTYGRNSFVWMGPTPRVTIMNPEDLKDAFNKSDEFQRAISNPIVKSISQGLSSLEGEKWAKHRKIINPAFHLEKLKGMLPTFYQSCSEMINKWESLVFKEGSREMDVWPYLENLTSDVISRAAFGSSYEEGRKIFQLLREEAKFYTIAARSVYIPGWRFLPTKQNKRMKEIHKEVRGLLKGIINKREDAIKAGEAAKGNLLGILMESNFREIQEHGNNKNAGMSIEDVIGECKLFYFAGQETTSVLLVWTLVLLSQNQDWQARAREEVLQVFGTNIPTYDQLSHLKVVTMILLEVLRLYPAVVELPRTTYKKTQLGKFLLPAGVEVSLHIMLAHHDKELWGEDAKEFKPERFSEGVSKATKNQFTYFPFGAGPRICIGQNFAMLEAKLALSLILQHFTFELSPSYAHAPSVTITLHPQFGAHFILHKR

SEQ ID NO: 272 - protein, 514 aa, Prunus mume
CVALSVVLVSIVIAWAWRVLNWVWLRPNKLERCLREQGLTGNSYRLLFGDTKEISMMVEQAQSKPIKLSTTHDIAPRVIPFSHQIVYTYGRNSFVWMGPTPRVTIMNPEDLKDAFNKSDEFQRAISNPIVKSISQGLSSLEGEKWAKHRKIINPAFHLEKLKGMLPTFYQSCSEMINKWESLVFKEGSREMDVWPYLENLTSDVISRAAFGSSYEEGRKIFQLLREEAKFYTIAARSVYIPGWRFLPTKQNKRMKEIHKEVRGLLKGIINKREDAIKAGEAAKGNLLGILMESNFREIQEHGNNKNAGMSIEDVIGECKLFYFAGQETTSVLLVWTLVLLSQNQDWQARAREEVLQVFGTNIPTYDQLSHLKVVTMILLEVLRLYPAVVELPRTTYKKTQLGKFLLPAGVEVSLHIMLAHHDKELWGEDAKEFKPERFSEGVSKATKNQFTYFPFGAGPRICIGQNFAMLEAKLALSLILQHFTFELSPSYAHAPSVTITLHPQFGAHFILHKR

SEQ ID NO: 273 - protein, 418 aa, Prunus persica
MGPIPRVHIMNPEDLKDTFNRHDDFHKVVKNPIMKSLPQGIVGIEGDQWAKHRKIINPAFHLEKLKGMVPIFYQSCSEMINIWKSLVSKESSCELDVWPYLENFTSDVISRAAFGSSYEEGRKIFQLLREEAKVYTVAVRSVYIPGWRFLPTKQNKKTKEIHNEIKGLLKGIINKREEAMKAGEATKDDLLGILMESNFREIQEHGNNKNAGMSIEDVIGECKLFYFAGQETTSVLLVWTMVLLSQNQDWQARAREEVLQVFGSNIPTYEELSHLKVVTMILLEVLRLYPSVVALPRTTHKKTQLGKLSLPAGVEVSLPILLVHHDKELWGEDANEFKPERFSEGVSKATKNQFTYFPFGGGPRICIGQNFAMMEAKLALSLILQHFTFELSPQYSHAPSVTITLQPQYGAHLILHKR

SEQ ID NO: 274 - DNA, 1578 bp, Artificial Sequence
  Codon-optimized KAH
atgggtttgttcccattagaggattcctacgcgctggtctttgaaggactagcaataacactggctttgtactatctactgtctttcatctacaaaacatctaaaaagacatgtacacctcctaaagcatctggtgaaatcattccaattacaggaatcatattgaatctgctatctggctcaagtggtctacctattatcttagcacttgcctctttagcagacagatgtggtcctattttcaccattaggctgggtattaggagagtgctagtagtatcaaattgggaaatcgctaaggagattttcactacccacgatttgatagtttctaatagaccaaaatacttagccgctaagattcttggtttcaattatgtttcattctctttcgctccatacggcccatattgggtcggaatcagaaagattattgctacaaaactaatgtcttcttccagacttcagaagttgcaatttgtaagagtttttgaactagaaaactctatgaaatctatcagagaatcatggaaggagaaaaaggatgaagagggaaaggtattagttgagatgaaaaagtggttctgggaactgaatatgaacatagtgttaaggacagttgctggtaaacaatacactggtacagttgatgatgccgatgcaaagcgtatctccgagttattcagagaatggtttcactacactggcagatttgtcgttggagacgcttttccttttctaggttggttggacctgggcggatacaaaaagacaatggaattagttgctagtagattggactcaatggtcagtaaatggttagatgagcatcgtaaaaagcaagctaacgatgacaaaaaggaggatatggatttcatggatatcatgatctccatgacagaagcaaattcaccacttgaaggatacggcactgatactattatcaagaccacatgtatgactttgattgtttcaggagttgatacaacctcaatcgtacttacttgggccttatcacttttgttaaacaacagagatactttgaaaaaggcacaagaggaattagatatgtgcgtaggtaaaggaagacaagtcaacgagtctgatcttgttaacttgatatacttggaagcagtgcttaaagaggctttaagactttacccagcagcgttcttaggcggaccaagagcattcttggaagattgtactgttgctggttatagaattccaaagggcacctgcttgttgattaacatgtggaaactgcatagagatccaaacatttggagtgatccttgcgaattcaagccagaaagatttttgacacctaatcaaaaggatgttgatgtgatcggtatggatttcgaattgataccatttggtgccggcagaagatattgtccaggtactagattggctttacagatgttgcatatcgtattagcgacattgctgcaaaacttcgaaatgtcaacaccaaacgatgcgccagtcgatatgactgcttctgttggcatgacaaatgccaaagcatcacctttagaagtcttgctatcacctcgtgttaaatggtcctaa

SEQ ID NO: 275 - protein, 522 aa, Stevia rebaudiana
MGLFPLEDSYALVFEGLAITLALYYLLSFIYKTSKKTCTPPKASGEHPITGHLNLLSGSSGLPHLALASLADRCGPIFTIRLGIRRVLVVSNWEIAKEIFTTHDLIVSNRPKYLAAKILGFNYVSFSFAPYGPYWVGIRKIIATKLMSSSRLQKLQFVRVFELENSMKSIRESWKEKKDEEGKVLVEMKKWFWELNMNIVLRTVAGKQYTGTVDDADAKRISELFREWFHYTGRFVVGDAFPFLGWLDLGGYKKTMELVASRLDSMVSKWLDEHRKKQANDDKKEDMDFMDIMISMTEANSPLEGYGTDTIIKTTCMTLIVSGVDTTSIVLTWALSLLLNNRDTLKKAQEELDMCVGKGRQVNESDLVNLIYLEAVLKEALRLYPAAFLGGPRAFLEDCTVAGYRIPKGTCLLINMWKLHRDPNIWSDPCEFKPERFLTPNQKDVDVIGMDFELIPFGAGRRYCPGTRLALQMLHIVLATLLQNFEMSTPNDAPVDMTASVGMTNAKASPLEVLLSPRVKWS

SEQ ID NO: 276 - DNA, 1431 bp, Artificial Sequence
  Codon-optimized KAH
atgatacaagttttaactccaattctactcttcctcatcttcttcgttttctggaaagtctacaaacatcaaaagactaaaatcaatctaccaccaggttccttcggctggccatttttgggtgaaaccttagccttacttagagcaggctgggattctgagccagaaagattcgtaagagagcgtatcaaaaagcatggatctccacttgttttcaagacatcactatttggagacagattcgctgttctttgcggtccagctggtaataagtttttgttctgcaacgaaaacaaattagtggcatcttggtggccagtccctgtaaggaagttgttcggtaaaagtttactcacaataagaggagatgaagcaaaatggatgagaaaaatgctattgtcttacttgggtccagatgcatttgccacacattatgccgttactatggatgttgtaacacgtagacatattgatgtccattggaggggcaaggaggaagttaatgtatttcaaacagttaagttgtacgcattcgaattagcttgtagattattcatgaacctagatgacccaaaccacatcgcgaaactcggtagtcttttcaacattttcctcaaagggatcatcgagcttcctatagacgttcctggaactagattttactccagtaaaaaggccgcagctgccattagaattgaattgaaaaagctcattaaagctagaaaactcgaattgaaggagggtaaggcgtcttcttcacaggacttgctttctcatctattaacatcacctgatgagaatgggatgttcttgacagaagaggaaatagtcgataacattctacttttgttattcgctggtcacgatacctctgcactatcaataacacttttgatgaaaaccttaggtgaacacagtgatgtgtacgacaaggttttgaaggaacaattagaaatttccaaaacaaaggaggcttgggaatcactaaagtgggaagatatccagaagatgaagtactcatggtcagtaatctgtgaagtcatgagattgaatcctcctgtcatagggacatacagagaggcgttggttgatatcgactatgctggttacactatcccaaaaggatggaagttgcattggtcagctgtttctactcaaagagacgaagccaatttcgaagatgtaactagattcgatccatccagatttgaaggggcaggccctactccattcacatttgtgcctttcggtggaggtcctagaatgtgtttaggcaaagagtttgccaggttagaagtgttagcatttctccacaacattgttaccaactttaagtgggatcttctaatccctgatgagaagatcgaatatgatccaatggctactccagctaagggcttgccaattagacttcatccacaccaagtctaa

SEQ ID NO: 277 - protein, 476 aa, Stevia rebaudiana
MIQVLTPILLFLIFFVFWKVYKHQKTKINLPPGSFGWPFLGETLALLRAGWDSEPERFVRERIKKHGSPLVFKTSLFGDRFAVLCGPAGNKFLFCNENKLVASWWPVPVRKLFGKSLLTIRGDEAKWMRKMLLSYLGPDAFATHYAVTMDVVTRRHIDVHWRGKEEVNVFQTVKLYAFELACRLFMNLDDPNHIAKLGSLFNIFLKGIIELPIDVPGTRFYSSKKAAAAIRIELKKLIKARKLELKEGKASSSQDLLSHLLTSPDENGMFLTEEEIVDNILLLLFAGHDTSALSITLLMKTLGEHSDVYDKVLKEQLEISKTKEAWESLKWEDIQKMKYSWSVICEVMRLNPPVIGTYREALVDIDYAGYTIPKGWKLHWSAVSTQRDEANFEDVTRFDPSRFEGAGPTPFTFVPFGGGPRMCLGKEFARLEVLAFLHNIVTNFKWDLLIPDEKIEYDPMATPAKGLPIRLHPHQV

SEQ ID NO: 278 - DNA, 1578 bp, Artificial Sequence
  Codon-optimized KAH
atggagtctttagtggttcatacagtaaatgctatctggtgtattgtaatcgtcgggattttctcagttggttatcacgtttacggtagagctgtggtcgaacaatggagaatgagaagatcactgaagctacaaggtgttaaaggcccaccaccatccatcttcaatggtaacgtctcagaaatgcaacgtatccaatccgaagctaaacactgctctggcgataacattatctcacatgattattcttcttcattattcccacacttcgatcactggagaaaacagtacggcagaatctacacatactctactggattaaagcaacacttgtacatcaatcatccagaaatggtgaaggagctatctcagactaacacattgaacttgggtagaatcacccatataaccaaaagattgaatcctatcttaggtaacggaatcataacctctaatggtcctcattgggcccatcagcgtagaattatcgcctacgagtttactcatgataagatcaagggtatggttggtttgatggttgagtctgctatgcctatgttgaataagtgggaggagatggtaaagagaggcggagaaatgggatgcgacataagagttgatgaggacttgaaagatgtttcagcagatgtgattgcaaaagcctgtttcggatcctcattttctaaaggtaaggctattttctctatgataagagatttgcttacagctatcacaaagagaagtgttctattcagattcaacggattcactgatatggtctttgggagtaaaaagcatggtgacgttgatatagacgctttagaaatggaattggaatcatccatttgggaaactgtcaaggaacgtgaaatagaatgtaaagatactcacaaaaaggatctgatgcaattgattttggaaggggcaatgcgttcatgtgacggtaacctttgggataaatcagcatatagaagatttgttgtagataattgtaaatctatctacttcgcagggcatgatagtacagctgtctcagtgtcatggtgtttgatgttactggccctaaacccatcatggcaagttaagatccgtgatgaaattctgtcttcttgcaaaaatggtattccagatgccgaaagtatcccaaaccttaaaacagtgactatggttattcaagagacaatgagattataccctccagcaccaatcgtcgggagagaagcctctaaagatatcagattgggcgatctagttgttcctaaaggcgtctgtatatggacactaataccagctttacacagagatcctgagatttggggaccagatgcaaacgatttcaaaccagaaagattttctgaaggaatttcaaaggcttgtaagtatcctcaaagttacattccatttggtctgggtcctagaacatgcgttggtaaaaactttggcatgatggaagtaaaggttcttgtttccctgattgtctccaagttctctttcactctatctcctacctaccaacatagtcctagtcacaaacttttagtagaaccacaacatggggtggtaattagagtggtttaa

SEQ ID NO: 279 - protein, 525 aa, Arabidopsis thaliana
MESLVVHTVNAIWCIVIVGIFSVGYHVYGRAVVEQWRMRRSLKLQGVKGPPPSIFNGNVSEMQRIQSEAKHCSGDNIISHDYSSSLFPHFDHWRKQYGRIYTYSTGLKQHLYINHPEMVKELSQTNTLNLGRITHITKRLNPILGNGIITSNGPHWAHQRRIIAYEFTHDKIKGMVGLMVESAMPMLNKWEEMVKRGGEMGCDIRVDEDLKDVSADVIAKACFGSSFSKGKAIFSMIRDLLTAITKRSVLFRFNGFTDMVFGSKKHGDVDIDALEMELESSIWETVKEREIECKDTHKKDLMQLILEGAMRSCDGNLWDKSAYRRFVVDNCKSIYFAGHDSTAVSVSWCLMLLALNPSWQVKIRDEILSSCKNGIPDAESIPNLKTVTMVIQETMRLYPPAPIVGREASKDIRLGDLVVPKGVCIWTLIPALHRDPEIWGPDANDFKPERFSEGISKACKYPQSYIPFGLGPRTCVGKNFGMMEVKVLVSLIVSKFSFTLSPTYQHSPSHKLLVEPQHGVVIRVV

SEQ ID NO: 280 - DNA, 1590 bp, Artificial Sequence
  Codon-optimized KAH
atgtacttcctactacaatacctcaacatcacaaccgttggtgtctttgccacattgtttctctcttattgtttacttctctggagaagtagagcgggtaacaaaaagattgccccagaagctgccgctgcatggcctattatcggccacctccacttacttgcaggtggatcccatcaactaccacatattacattgggtaacatggcagataagtacggtcctgtattcacaatcagaataggcttgcatagagctgtagttgtctcatcttgggaaatggcaaaggaatgttcaacagctaatgatcaagtgtcttcttcaagacctgaactattagcttctaagttgttgggttataactacgccatgtttggtttttcaccatacggttcatactggagagaaatgagaaagatcatctctctcgaattactatctaattccagattggaactattgaaagatgttagagcctcagaagttgtcacatctattaaggaactatacaaattgtgggcggaaaagaagaatgagtcaggattggtttctgtcgagatgaaacaatggttcggagatttgactttaaacgtgatcttgagaatggtggctggtaaaagatacttctccgcgagtgacgcttcagaaaacaaacaggcccagcgttgtagaagagtcttcagagaattcttccatctctccggcttgtttgtggttgctgatgctataccttttcttggatggctcgattggggaagacacgagaagaccttgaaaaagaccgccatagaaatggattccatcgcccaggagtggcttgaggaacatagacgtagaaaagattctggagatgataattctacccaagatttcatggacgttatgcaatctgtgctagatggcaaaaatctaggcggatacgatgctgatacgattaacaaggctacatgcttaactcttatatcaggtggcagtgatactactgtagtttctttgacatgggctcttagtcttgtgttaaacaatagagatactttgaaaaaggcacaggaagagttagacatccaagtcggtaaggaaagattggttaacgagcaagacatcagtaagttagtttacttgcaagcaatagtaaaagagacactcagactttatccaccaggtcctttgggtggtttgagacaattcactgaagattgtacactaggtggctatcacgtttcaaaaggaactagattaatcatgaacttatccaagattcaaaaagatccacgtatttggtctgatcctactgaattccaaccagagagattccttacgactcataaagatgtcgatccacgtggtaaacactttgaattcattccattcggtgcaggaagacgtgcatgtcctggtatcacattcggattacaagtactacatctaacattggcatctttcttgcatgcgtttgaattttcaacaccatcaaatgagcaggttaacatgagagaatcattaggtcttacgaatatgaaatctaccccattagaagttttgatttctccaagactatcccttaattgcttcaaccttatgaaaatttga

SEQ ID NO: 281 - protein, 526 aa, Vitis vinifera
MYFLLQYLNITTVGVFATLFLSYCLLLWRSRAGNKKIAPEAAAAWPIIGHLHLLAGGSHQLPHITLGNMADKYGPVFTIRIGLHRAVVVSSWEMAKECSTANDQVSSSRPELLASKLLGYNYAMFGFSPYGSYWREMRKIISLELLSNSRLELLKDVRASEVVTSIKELYKLWAEKKNESGLVSVEMKQWFGDLTLNVILRMVAGKRYFSASDASENKQAQRCRRVFREFFHLSGLFVVADAIPFLGWLDWGRHEKTLKKTAIEMDSIAQEWLEEHRRRKDSGDDNSTQDFMDVMQSVLDGKNLGGYDADTINKATCLTLISGGSDTTVVSLTWALSLVLNNRDTLKKAQEELDIQVGKERLVNEQDISKLVYLQAIVKETLRLYPPGPLGGLRQFTEDCTLGGYHVSKGTRLIMNLSKIQKDPRIWSDPTEFQPERFLTTHKDVDPRGKHFEFIPFGAGRRACPGITFGLQVLHLTLASFLHAFEFSTPSNEQVNMRESLGLTNMKSTPLEVLISPRLSSCSLYN

SEQ ID NO: 282 - DNA, 1440 bp, Artificial Sequence
  Codon-optimized KAH
atggaacctaacttttacttgtcattactattgttgttcgtgaccttcatttctttaagtctgtttttcatcttttacaaacaaaagtccccattgaatttgccaccagggaaaatgggttaccctatcataggtgaaagtttagaattcctatccacaggctggaagggacatcctgaaaagttcatatttgatagaatgcgtaagtacagtagtgagttattcaagacttctattgtaggcgaatccacagttgtttgctgtggggcagctagtaacaaattcctattctctaacgaaaacaaactggtaactgcctggtggccagattctgttaacaaaatcttcccaacaacttcactggattctaatttgaaggaggaatctataaagatgagaaagttgctgccacagttcttcaaaccagaagcacttcaaagatacgtcggcgttatggatgtaatcgcacaaagacattttgtcactcactgggacaacaaaaatgagatcacagtttatccacttgctaaaagatacactttcttgcttgcgtgtagactgttcatgtctgttgaggatgaaaatcatgtggcgaaattctcagacccattccaactaatcgctgcaggcatcatttcacttcctatcgatcttcctggtactccattcaacaaggccataaaggcttcaaatttcattagaaaagagctgataaagattatcaaacaaagacgtgttgatctggcagagggtacagcatctccaacccaggatatcttgtcacatatgctattaacatctgatgaaaacggtaaatctatgaacgagttgaacattgccgacaagattcttggactattgataggaggccacgatacagcttcagtagcttgcacatttctagtgaagtacttaggagaattaccacatatctacgataaagtctaccaagagcaaatggaaattgccaagtccaaacctgctggggaattgttgaattgggatgacttgaaaaagatgaagtattcatggaatgtggcatgtgaggtaatgagattgtcaccacctttacaaggtggttttagagaggctataactgactttatgtttaacggtttctctattccaaaagggtggaagttatactggtccgccaactctacacacaaaaatgcagaatgtttcccaatgcctgagaaattcgatcctaccagatttgaaggtaatggtccagcgccttatacatttgtaccattcggtggaggccctagaatgtgtcctggaaaggaatacgctagattagaaatcttggttttcatgcataatctggtcaaacgttttaagtgggaaaaggttattccagacgaaaagattattgtcgatccattcccaatcccagctaaagatcttccaatccgtttgtatcctcacaaagcttaa

SEQ ID NO: 283 - protein, 479 aa, Medicago truncatula
MEPNFYLSLLLLFVTFISLSLFFIFYKQKSPLNLPPGKMGYPIIGESLEFLSTGWKGHPEKFIFDRMRKYSSELFKTSIVGESTVVCCGAASNKFLFSNENKLVTAWWPDSVNKIFPTTSLDSNLKEESIKMRKLLPQFFKPEALQRYVGVMDVIAQRHFVTHWDNKNEITVYPLAKRYTFLLACRLFMSVEDENHVAKFSDPFQLIAAGIISLPIDLPGTPFNKAIKASNFIRKELIKIIKQRRVDLAEGTASPTQDILSHMLLTSDENGKSMNELNIADKILGLLIGGHDTASVACTFLVKYLGELPHIYDKVYQEQMEIAKSKPAGELLNWDDLKKMKYSWNVACEVMRLSPPLQGGFREAITDFMFNGFSIPKGWKLYWSANSTHKNAECFPMPEKFDPTRFEGNGPAPYTFVPFGGGPRMCPGKEYARLEILVFMHNLVKRFKWEKVIPDEKIIVDPFPIPAKDLPIRLYPHKA

SEQ ID NO: 284 - DNA, 1422 bp, Artificial Sequence
  Codon-optimized UGT91D2e
atggctacatctgattctattgttgatgacaggaagcagttgcatgtggctactttcccttggcttgctttcggtcatatactgccttacctacaactatcaaaactgatagctgaaaaaggacataaagtgtcattcctttcaacaactagaaacattcaaagattatcttcccacatatcaccattgattaacgtcgttcaattgacacttccaagagtacaggaattaccagaagatgctgaagctacaacagatgtgcatcctgaagatatcccttacttgaaaaaggcatccgatggattacagcctgaggtcactagattccttgagcaacacagtccagattggatcatatacgactacactcactattggttgccttcaattgcagcatcactaggcatttctagggcacatttcagtgtaaccacaccttgggccattgcttacatgggtccatccgctgatgctatgattaacggcagtgatggtagaactaccgttgaagatttgacaaccccaccaaagtggtttccatttccaactaaagtctgttggagaaaacacgacttagcaagactggttccatacaaggcaccaggaatctcagacggctatagaatgggtttagtccttaaagggtctgactgcctattgtctaagtgttaccatgagtttgggacacaatggctaccacttttggaaacattacaccaagttcctgtcgtaccagttggtctattacctccagaaatccctggtgatgagaaggacgagacttgggtttcaatcaaaaagtggttagacgggaagcaaaaaggctcagtggtatatgtggcactgggttccgaagttttagtatctcaaacagaagttgtggaacttgccttaggtttggaactatctggattgccatttgtctgggcctacagaaaaccaaaaggccctgcaaagtccgattcagttgaattgccagacggctttgtcgagagaactagagatagagggttggtatggacttcatgggctccacaattgagaatcctgagtcacgaatctgtgtgcggtttcctaacacattgtggttctggttctatagttgaaggactgatgtttggtcatccacttatcatgttgccaatctttggtgaccagcctttgaatgcacgtctgttagaagataaacaagttggaattgaaatcccacgtaatgaggaagatggatgtttaaccaaggagtctgtggccagatcattacgttccgttgtcgttgaaaaggaaggcgaaatctacaaggccaatgcccgtgaactttcaaagatctacaatgacacaaaagtagagaaggaatatgtttctcaatttgtagattacctagagaaaaacgctagagccgtagctattgatcatgaatcctaa

SEQ ID NO: 285 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 286 - DNA, 2142 bp, Artificial Sequence
  Codon-optimized CPR
atggcagaattagatacacttgatatagtagtattaggtgttatctttttgggtactgtggcatactttactaagggtaaattgtggggtgttaccaaggatccatacgctaacggattcgctgcaggtggtgcttccaagcctggcagaactagaaacatcgtcgaagctatggaggaatcaggtaaaaactgtgttgttttctacggcagtcaaacaggtacagcggaggattacgcatcaagacttgcaaaggaaggaaagtccagattcggtttgaacactatgatcgccgatctagaagattatgacttcgataacttagacactgttccatctgataacatcgttatgtttgtattggctacttacggtgaaggcgaaccaacagataacgccgtggatttctatgagttcattactggcgaagatgcctctttcaatgagggcaacgatcctccactaggtaacttgaattacgttgcgttcggtctgggcaacaatacctacgaacactacaactcaatggtcaggaacgttaacaaggctctagaaaagttaggagctcatagaattggagaagcaggtgagggtgacgacggagctggaactatggaagaggactttttagcttggaaagatccaatgtgggaagccttggctaaaaagatgggcttggaggaaagagaagctgtatatgaacctattttcgctatcaatgagagagatgatttgacccctgaagcgaatgaggtatacttgggagaacctaataagctacacttggaaggtacagcgaaaggtccattcaactcccacaacccatatatcgcaccaattgcagaatcatacgaacttttctcagctaaggatagaaattgtctgcatatggaaattgatatttctggtagtaatctaaagtatgaaacaggcgaccatatcgcgatctggcctaccaacccaggtgaagaggtcaacaaatttcttgacattctagatctgtctggtaagcaacattccgtcgtaacagtgaaagccttagaacctacagccaaagttccttttccaaatccaactacctacgatgctatattgagataccatctggaaatatgcgctccagtttctagacagtttgtctcaactttagcagcattcgcccctaatgatgatatcaaagctgagatgaaccgtttgggatcagacaaagattacttccacgaaaagacaggaccacattactacaatatcgctagatttttggcctcagtctctaaaggtgaaaaatggacaaagataccattttctgctttcatagaaggccttacaaaactacaaccaagatactattctatctcttcctctagtttagttcagcctaaaaagattagtattactgctgttgtcgaatctcagcaaattccaggtagagatgacccattcagaggtgtagcgactaactacttgttcgctttgaagcagaaacaaaacggtgatccaaatccagctccttttggccaatcatacgagttgacaggaccaaggaataagtatgatggtatacatgttccagtccatgtaagacattctaactttaagctaccatctgatccaggcaaacctattatcatgatcggtccaggtaccggtgttgccccttttagaggcttcgtccaagagagggcaaaacaagccagagatggtgtagaagttggtaaaacactgctgttctttggatgtagaaagagtacagaagatttcatgtatcaaaaagagtggcaagagtacaaggaagctcttggcgacaaattcgaaatgattacagctttttcaagagaaggatctaaaaaggtttatgttcaacacagactgaaggaaagatcaaaggaagtttctgatcttctatcccaaaaagcatacttctacgtttgcggagacgccgcacatatggcacgtgaagtgaacactgtgttagcacagatcatagcagaaggccgtggtgtatcagaagccaagggtgaggaaattgtcaaaaacatgagatcagcaaatcaataccaagtgtgttctgatttcgtaactttacactgtaaagagacaacatacgcgaattcagaattgcaagaggatgtctggagttaa

SEQ ID NO: 287 - protein, 713 aa, Gibberella fujikuroi
MAELDTLDIVVLGVIFLGTVAYFTKGKLWGVTKDPYANGFAAGGASKPGRTRNIVEAMEESGKNCVVFYGSQTGTAEDYASRLAKEGKSRFGLNTMIADLEDYDFDNLDTVPSDNIVMFVLATYGEGEPTDNAVDFYEFITGEDASFNEGNDPPLGNLNYVAFGLGNNTYEHYNSMVRNVNKALEKLGAHRIGEAGEGDDGAGTMEEDFLAWKDPMWEALAKKMGLEEREAVYEPIFAINERDDLTPEANEVYLGEPNKLHLEGTAKGPFNSHNPYIAPIAESYELFSAKDRNCLHMEIDISGSNLKYETGDHIAIWPTNPGEEVNKFLDILDLSGKQHSVVTVKALEPTAKVPFPNPTTYDAILRYHLEICAPVSRQFVSTLAAFAPNDDIKAEMNRLGSDKDYFHEKTGPHYYNIARFLASVSKGEKWTKIPFSAFIEGLTKLQPRYYSISSSSLVQPKKISITAVVESQQIPGRDDPFRGVATNYLFALKQKQNGDPNPAPFGQSYELTGPRNKYDGIHVPVHVRHSNFKLPSDPGKPIIMIGPGTGVAPFRGFVQERAKQARDGVEVGKTLLFFGCRKSTEDFMYQKEWQEYKEALGDKFEMITAFSREGSKKVYVQHRLKERSKEVSDLLSQKAYFYVCGDAAHMAREVNTVLAQIIAEGRGVSEAKGEEIVKNMRSANQYQVCSDFVTLHCKETTYANSELQEDVWS

SEQ ID NO: 288 - DNA, 2130 bp, Stevia rebaudiana
atgcaatcggaatccgttgaagcatcgacgattgatttgatgactgctgttttgaaggacacagtgatcgatacagcgaacgcatctgataacggagactcaaagatgccgccggcgttggcgatgatgttcgaaattcgtgatctgttgctgattttgactacgtcagttgctgttttggtcggatgtttcgttgttttggtgtggaagagatcgtccgggaagaagtccggcaaggaattggagccgccgaagatcgttgtgccgaagaggcggctggagcaggaggttgatgatggtaagaagaaggttacgattttcttcggaacacaaactggaacggctgaaggtttcgctaaggcacttttcgaagaagcgaaagcgcgatatgaaaaggcagcgtttaaagtgattgatttggatgattatgctgctgatttggatgagtatgcagagaagctgaagaaggaaacatatgctttcttcttcttggctacatatggagatggtgagccaactgataatgctgccaaattttataaatggtttactgagggagacgagaaaggcgtttggcttcaaaaacttcaatatggagtatttggtcttggcaacagacaatatgaacatttcaacaagattggaatagtggttgatgatggtctcaccgagcagggtgcaaaacgcattgttcccgttggtcttggagacgacgatcaatcaattgaagacgatttttcggcatggaaagagttagtgtggcccgaattggatctattgcttcgcgatgaagatgacaaagctgctgcaactccttacacagctgcaatccctgaataccgcgtcgtatttcatgacaaacccgatgcgttttctgatgatcatactcaaaccaatggtcatgctgttcatgatgctcaacatccatgcagatccaatgtggctgttaaaaaagagcttcatactcctgaatccgatcgttcatgcacacatcttgaatttgacatttctcacactggattatcttatgaaactggggatcatgttggtgtatactgtgaaaacctaattgaagtagtggaagaagctgggaaattgttaggattatcaacagatacttatttctcgttacatattgataacgaagatggttcaccacttggtggaccttcattacaacctccttttcctccttgtactttaagaaaagcattgactaattatgcagatctgttaagctctcccaaaaagtcaactttgcttgctctagctgctcatgcttccgatcccactgaagctgatcgtttaagatttcttgcatctcgcgagggcaaggatgaatatgctgaatgggttgttgcaaaccaaagaagtcttcttgaagtcatggaagctttcccgtcagctagaccgccacttggtgttttctttgcagcggttgcaccgcgtttacagcctcgttactactctatttcttcctccccaaagatggaaccaaacaggattcatgttacttgcgcgttggtttatgaaaaaactcccgcaggtcgtatccacaaaggaatctgctcaacctggatgaagaacgctgtacctttgaccgaaagtcaagattgcagttgggcaccgatttttgttagaacatcaaacttcagacttccaattgacccgaaagtcccggttatcatgattggtcctggaaccgggttggctccatttaggggttttcttcaagaaagattggctcttaaagaatccggaaccgaactcgggtcatctattttattcttcggttgtagaaaccgcaaagtggattacatatatgagaatgaactcaacaactttgttgaaaatggtgcgctttctgagcttgatgttgctttctcccgcgatggcccgacgaaagaatacgtgcaacataaaatgacccaaaaggcttctgaaatatggaatatgctttctgagggagcatatttatatgtatgtggtgatgctaaaggcatggctaaagatgtacaccgtacacttcacaccattgtgcaagaacagggaagtttggactcgtctaaagcggagttgtatgtgaagaatctacaaatgtcaggaagatacctccgtgatgtttggtaa

SEQ ID NO: 289 - protein, 709 aa, Stevia rebaudiana
MQSESVEASTIDLMTAVLKDTVIDTANASDNGDSKMPPALAMMFEIRDLLLILTTSVAVLVGCFVVLVWKRSSGKKSGKELEPPKIVVPKRRLEQEVDDGKKKVTIFFGTQTGTAEGFAKALFEEAKARYEKAAFKVIDLDDYAADLDEYAEKLKKETYAFFFLATYGDGEPTDNAAKFYKWFTEGDEKGVWLQKLQYGVFGLGNRQYEHFNKIGIVVDDGLTEQGAKRIVPVGLGDDDQSIEDDFSAWKELVWPELDLLLRDEDDKAAATPYTAAIPEYRVVFHDKPDAFSDDHTQTNGHAVHDAQHPCRSNVAVKKELHTPESDRSCTHLEFDISHTGLSYETGDHVGVYCENLIEVVEEAGKLLGLSTDTYFSLHIDNEDGSPLGGPSLQPPFPPCTLRKALTNYADLLSSPKKSTLLALAAHASDPTEADRLRFLASREGKDEYAEWVVANQRSLLEVMEAFPSARPPLGVFFAAVAPRLQPRYYSISSSPKMEPNRIHVTCALVYEKTPAGRIHKGICSTWMKNAVPLTESQDCSWAPIFVRTSNFRLPIDPKVPVIMIGPGTGLAPFRGFLQERLALKESGTELGSSILFFGCRNRKVDYIYENELNNFVENGALSELDVAFSRDGPTKEYVQHKMTQKASEIWNMLSEGAYLYVCGDAKGMAKDVHRTLHTIVQEQGSLDSSKAELYVKNLQMSGRYLRDVW

SEQ ID NO: 290 - DNA, 2070 bp, Artificial Sequence
  Codon-optimized CPR
atgtcctccaactccgatttggtcagaagattggaatctgttttgggtgtttctttcggtggttctgttactgattccgttgttgttattgctaccacctctattgctttggttatcggtgttttggttttgttgtggagaagatcctctgacagatctagagaagttaagcaattggctgttccaaagccagttactatcgttgaagaagaagatgaattcgaagttgcttctggtaagaccagagtttctattttctacggtactcaaactggtactgctgaaggttttgctaaggctttggctgaagaaatcaaagccagatacgaaaaagctgccgttaaggttattgatttggatgattacacagccgaagatgacaaatacggtgaaaagttgaagaaagaaactatggccttcttcatgttggctacttatggtgatggtgaacctactgataatgctgctagattttacaagtggttcaccgaaggtactgatagaggtgtttggttggaacatttgagatacggtgtattcggtttgggtaacagacaatacgaacacttcaacaagattgccaaggttgttgatgatttgttggttgaacaaggtgccaagagattggttactgttggtttgggtgatgatgatcaatgcatcgaagatgatttctccgcttggaaagaagccttgtggccagaattggatcaattattgcaagatgataccaacaccgtttctactccatacactgctgttattccagaatacagagttgttatccacgatccatctgttacctcttatgaagatccatactctaacatggctaacggtaatgcctcttacgatattcatcatccatgtagagctaacgttgccgtccaaaaagaattgcataagccagaatctgacagaagttgcatccatttggaattcgatattttcgctactggtttgacttacgaaaccggtgatcatgttggtgtttacgctgataattgtgatgatactgtagaagaagccgctaagttgttgggtcaaccattggatttgttgttctccattcataccgataacaacgacggtacttctttgggttcttctttgccaccaccatttccaggtccatgtactttgagaactgctttggctagatatgccgatttgttgaatccaccaaaaaaggctgctttgattgctttagctgctcatgctgatgaaccatctgaagctgaaagattgaagttcttgtcatctccacaaggtaaggacgaatattctaaatgggttgtcggttcccaaagatccttggttgaagttatggctgaatttccatctgctaaaccaccattgggtgtattttttgctgctgttgttcctagattgcaacctagatattactccatctcttccagtccaagatttgctccacatagagttcatgttacttgcgctttggtttatggtccaactccaactggtagaattcacagaggtgtatgttcattctggatgaagaatgttgtcccattggaaaagtctcaaaactgttcttgggccccaattttcatcagacaatctaatttcaagttgccagccgatcattctgttccaatagttatggttggtccaggtactggtttagctccttttagaggtttcttacaagaaagattggccttgaaagaagaaggtgctcaagttggtcctgctttgttgttttttggttgcagaaacagacaaatggacttcatctacgaagtcgaattgaacaactttgtcgaacaaggtgctttgtccgaattgatcgttgctttttcaagagaaggtccatccaaagaatacgtccaacataagatggttgaaaaggcagcttacatgtggaacttgatttctcaaggtggttacttctacgtttgtggtgatgctaaaggtatggctagagatgttcatagaacattgcataccatcgtccaacaagaagaaaaggttgattctaccaaggccgaatccatcgttaagaaattgcaaatggacggtagatacttgagagatgtttggtga

SEQ ID NO: 291 - protein, 689 aa, Rubus suavissimus
MSSNSDLVRRLESVLGVSFGGSVTDSVVVIATTSIALVIGVLVLLWRRSSDRSREVKQLAVPKPVTIVEEEDEFEVASGKTRVSIFYGTQTGTAEGFAKALAEEIKARYEKAAVKVIDLDDYTAEDDKYGEKLKKETMAFFMLATYGDGEPTDNAARFYKWFTEGTDRGVWLEHLRYGVFGLGNRQYEHFNKIAKVVDDLLVEQGAKRLVTVGLGDDDQCIEDDFSAWKEALWPELDQLLQDDTNTVSTPYTAVIPEYRVVIHDPSVTSYEDPYSNMANGNASYDIHHPCRANVAVQKELHKPESDRSCIHLEFDIFATGLTYETGDHVGVYADNCDDTVEEAAKLLGQPLDLLFSIHTDNNDGTSLGSSLPPPFPGPCTLRTALARYADLLNPPKKAALIALAAHADEPSEAERLKFLSSPQGKDEYSKWVVGSQRSLVEVMAEFPSAKPPLGVFFAAVVPRLQPRYYSISSSPRFAPHRVHVTCALVYGPTPTGRIHRGVCSFWMKNVVPLEKSQNCSWAPIFIRQSNFKLPADHSVPIVMVGPGTGLAPFRGFLQERLALKEEGAQVGPALLFFGCRNRQMDFIYEVELNNFVEQGALSELIVAFSREGPSKEYVQHKMVEKAAYMWNLISQGGYFYVCGDAKGMARDVHRTLHTIVQQEEKVDSTKAESIVKKLQMDGRYLRDVW

SEQ ID NO: 292 - DNA, 2079 bp, Artificial Sequence
  Codon-optimized CPR
atgacttctgcactttatgcctccgatcttttcaaacaattgaaaagtatcatgggaacggattctttgtccgatgatgttgtattagttattgctacaacttctctggcactggttgctggtttcgttgtcttattgtggaaaaagaccacggcagatcgttccggcgagctaaagccactaatgatccctaagtctctgatggcgaaagatgaggatgatgacttagatctaggttctggaaaaacgagagtctctatcttcttcggcacacaaaccggaacagccgaaggattcgctaaagcactttcagaagagatcaaagcaagatacgaaaaggcggctgtaaaagtaatcgatttggatgattacgctgccgatgatgaccaatatgaggaaaagttgaaaaaggaaacattggctttcttttgtgtagccacgtatggtgatggtgaaccaaccgataacgccgcaagattctacaagtggtttactgaagagaacgaaagagatatcaagttgcagcaacttgcttacggcgtttttgccttaggtaacagacaatacgagcactttaacaagataggtattgtcttagatgaagagttatgcaaaaagggtgcgaagagattgattgaagtcggtttaggagatgatgatcaatctatcgaggatgactttaatgcatggaaggaatctttgtggtctgaattagataagttacttaaggacgaagatgataaatccgttgccactccatacacagccgtcattccagaatatagagtagttactcatgatccaagattcacaacacagaaatcaatggaaagtaatgtggctaatggtaatactaccatcgatattcatcatccatgtagagtagacgttgcagttcaaaaggaattgcacactcatgaatcagacagatcttgcatacatcttgaatttgatatatcacgtactggtatcacttacgaaacaggtgatcacgtgggtgtctacgctgaaaaccatgttgaaattgtagaggaagctggaaagttgttgggccatagtttagatcttgttttctcaattcatgccgataaagaggatggctcaccactagaaagtgcagtgcctccaccatttccaggaccatgcaccctaggtaccggtttagctcgttacgcggatctgttaaatcctccacgtaaatcagctctagtggccttggctgcgtacgccacagaaccttctgaggcagaaaaactgaaacatctaacttcaccagatggtaaggatgaatactcacaatggatagtagctagtcaacgttctttactagaagttatggctgctttcccatccgctaaacctcctttgggtgttttcttcgccgcaatagcgcctagactgcaaccaagatactattcaatttcatcctcacctagactggcaccatcaagagttcatgtcacatccgctttagtgtacggtccaactcctactggtagaatccataagggcgtttgttcaacatggatgaaaaacgcggttccagcagagaagtctcacgaatgttctggtgctccaatctttatcagagcctccaacttcaaactgccttccaatccttctactcctattgtcatggtcggtcctggtacaggtcttgctccattcagaggtttcttacaagagagaatggccttaaaggaggatggtgaagagttgggatcttctttgttgtttttcggctgtagaaacagacaaatggatttcatctacgaagatgaactgaataactttgtagatcaaggagttatttcagagttgataatggctttttctagagaaggtgctcagaaggagtacgtccaacacaaaatgatggaaaaggccgcacaagtttgggacttaatcaaagaggaaggctatctatatgtctgtggtgatgcaaagggtatggcaagagatgttcacagaacacttcatactatagtccaggaacaggaaggcgttagttcttctgaagcggaagcaattgtgaaaaagttacaaacagagggaagatacttgagagatgtgtggtaa

SEQ ID NO: 293 - protein, 692 aa, Arabidopsis thaliana [sequence omitted]

SEQ ID NO: 294 - DNA, 1572 bp, Rubus suavissimus
atggaagtaacagtagctagtagtgtagccctgagcctggtctttattagcatagtagtaagatgggcatggagtgtggtgaattgggtgtggtttaagccgaagaagctggaaagatttttgagggagcaaggccttaaaggcaattcctacaggtttttatatggagacatgaaggagaactctatcctgctcaaacaagcaagatccaaacccatgaacctctccacctcccatgacatagcacctcaagtcaccccttttgtcgaccaaaccgtgaaagcttacggtaagaactcttttaattgggttggccccataccaagggtgaacataatgaatccagaagatttgaaggacgtcttaacaaaaaatgttgactttgttaagccaatatcaaacccacttatcaagttgctagctacaggtattgcaatctatgaaggtgagaaatggactaaacacagaaggattatcaacccaacattccattcggagaggctaaagcgtatgttaccttcatttcaccaaagttgtaatgagatggtcaaggaatgggagagcttggtgtcaaaagagggttcatcatgtgagttggatgtctggccttttcttgaaaatatgtcggcagatgtgatctcgagaacagcatttggaactagctacaaaaaaggacagaaaatctttgaactcttgagagagcaagtaatatatgtaacgaaaggctttcaaagtttttacattccaggatggaggtttctcccaactaagatgaacaagaggatgaatgagattaacgaagaaataaaaggattaatcaggggtattataattgacagagagcaaatcattaaggcaggtgaagaaaccaacgatgacttattaggtgcacttatggagtcaaacttgaaggacattcgggaacatgggaaaaacaacaaaaatgttgggatgagtattgaagatgtaattcaggagtgtaagctgttttactttgctgggcaagaaaccacttcagtgttgctggcttggacaatggttttacttggtcaaaatcagaactggcaagatcgagcaagacaagaggttttgcaagtctttggaagcagcaagccagattttgatggtctagctcaccttaaagtcgtaaccatgattttgcttgaagttcttcgattatacccaccagtcattgaacttattcgaaccattcacaagaaaacacaacttgggaagctctcactaccagaaggagttgaagtccgcttaccaacactgctcattcaccatgacaaggaactgtggggtgatgatgcaaaccagttcaatccagagaggttttcggaaggagtttccaaagcaacaaagaaccgactctcattcttccccttcggagccggtccacgcatttgcattggacagaacttttctatgatggaagcaaagttggccttagcattgatcttgcaacacttcacctttgagctttctccatctcatgcacatgctccttcccatcgtataacccttcaaccacagtatggtgttcgtatcattttacatcgacgttag

SEQ ID NO: 295 - DNA, 1572 bp, Artificial Sequence
  Codon-optimized KAH
atggaagtcactgtcgcctcttctgtcgctttatccttagtcttcatttccattgtcgtcagatgggcttggtccgttgtcaactgggtttggttcaaaccaaagaagttggaaagattcttgagagagcaaggtttgaagggtaattcttatagattcttgtacggtgacatgaaggaaaattctattttgttgaagcaagccagatccaaaccaatgaacttgtctacctctcatgatattgctccacaagttactccattcgtcgatcaaactgttaaagcctacggtaagaactctttcaattgggttggtccaattcctagagttaacatcatgaacccagaagatttgaaggatgtcttgaccaagaacgttgacttcgttaagccaatttccaacccattgattaaattgttggctactggtattgccatttacgaaggtgaaaagtggactaagcatagaagaatcatcaaccctaccttccactctgaaagattgaagagaatgttaccatctttccatcaatcctgtaatgaaatggttaaggaatgggaatccttggtttctaaagaaggttcttcttgcgaattggatgtttggccattcttggaaaatatgtctgctgatgtcatttccagaaccgctttcggtacctcctacaagaagggtcaaaagattttcgaattgttgagagagcaagttatttacgttaccaagggtttccaatccttctacatcccaggttggagattcttgccaactaaaatgaacaagcgtatgaacgagatcaacgaagaaattaaaggtttgatcagaggtattattatcgacagagaacaaattattaaagctggtgaagaaaccaacgatgatttgttgggtgctttgatggagtccaacttgaaggatattagagaacatggtaagaacaacaagaatgttggtatgtctattgaagatgttattcaagaatgtaagttattctacttcgctggtcaagagaccacttctgttttgttagcctggactatggtcttgttaggtcaaaaccaaaattggcaagatagagctagacaagaagttttgcaagtcttcggttcttccaagccagactttgatggtttggcccacttgaaggttgttactatgattttgttagaagttttgagattgtacccaccagtcattgagttaatcagaaccattcataaaaagactcaattgggtaaattatctttgccagaaggtgttgaagtcagattaccaaccttgttgattcaccacgataaggaattatggggtgacgacgctaatcaatttaatccagaaagattttccgaaggtgtttccaaggctaccaaaaaccgtttgtccttcttcccatttggtgctggtccacgtatttgtatcggtcaaaacttttccatgatggaagccaagttggctttggctttaatcttgcaacacttcactttcgaattgtctccatcccatgcccacgctccttctcatagaatcactttacaaccacaatacggtgtcagaatcatcttacacagaagataa

What is claimed is:

1. A recombinant host cell producing a steviol glycoside in a cell culture, wherein the host cell comprises a recombinant gene encoding a Sugar Efflux Transporter (SET) polypeptide having at least 95% sequence identity to the amino acid sequence set forth in SEQ ID NO:18;
    wherein the recombinant host cell expresses exogenous nucleic acids encoding:
    (a) a polypeptide capable of synthesizing geranylgeranyl pyrophosphate (GGPP) from farnesyl diphosphate (FPP) and isopentenyl diphosphate (IPP);
    (b) a polypeptide capable of synthesizing ent-copalyl diphosphate from GGPP;
    (c) a polypeptide capable of synthesizing ent-kaurenoic acid from ent-kaurene;
    (d) a polypeptide capable of synthesizing ent-kaurene from ent-copalyl pyrophosphate;
    (e) a polypeptide capable of synthesizing steviol from ent-kaurenoic acid;
    (f) a polypeptide capable of reducing cytochrome P450 complex; and
    (g) one or more uridine diphosphate (UDP) glycosyltransferases (UGTs) polypeptide; and
    wherein the host cell is a plant cell, a fungal cell, or a bacterial cell.

2. The host cell of claim 1, wherein the host cell further comprises a deletion of a gene encoding a trafficking adapter polypeptide having at least 95% sequence identity to the amino acid sequence set forth in SEQ ID NO:46.

3. The host cell of claim 2, wherein the deletion of the gene encoding the polypeptide having at least 95% sequence identity to the amino acid sequence set forth in SEQ ID NO:46 increases excretion of Rebaudioside D (RebD).

4. The host cell of claim 2, wherein the deletion of the gene encoding the polypeptide having at least 95% sequence identity to the amino acid sequence set forth in SEQ ID NO:48 increases excretion of Rebaudioside M (RebM).

5. The host cell of claim 1, wherein the host cell further comprises a deletion of a gene encoding a transporter polypeptide having the amino acid sequence set forth in SEQ ID NO:102 or a functional homolog thereof.

6. The recombinant host cell of claim 1, wherein:
    (a) the polypeptide capable of synthesizing geranylgeranyl pyrophosphate (GGPP) from farnesyl diphosphate (FPP) and isopentenyl diphosphate (IPP) comprises a polypeptide having at least 95% sequence identity to the amino acid sequence set forth in SEQ ID NO:182;
    (b) the polypeptide capable of synthesizing ent-copalyl diphosphate from GGPP comprises a polypeptide having at least 95% sequence identity to the amino acid sequence set forth in SEQ ID NO:184;
    (c) the polypeptide capable of synthesizing ent-kaurenoic acid from ent-kaurene comprises a polypeptide having at least 95% sequence identity to the amino acid sequence set forth in SEQ ID NO:188;
    (d) the polypeptide capable of synthesizing ent-kaurene from ent-copalyl pyrophosphate comprises a polypeptide having at least 95% sequence identity to the amino acid sequence set forth in SEQ ID NO:186;
    (e) the polypeptide capable of synthesizing steviol from ent-kaurenoic acid comprises a polypeptide having at least 95% sequence identity to the amino acid sequence set forth in SEQ ID NO:192;
    (f) the polypeptide capable of reducing cytochrome P450 complex comprises a polypeptide having at least 95% sequence identity to the amino acid sequence set forth in SEQ ID NO:194; and wherein the one or more uridine diphosphate (UDP) glycosyltransferases (UGTs) polypeptide comprises:
    (g) a polypeptide capable of glycosylating steviol or a steviol glycoside at its C-13 hydroxyl group;
        wherein the polypeptide comprises a polypeptide having at least 95% sequence identity to the amino acid sequence set forth in SEQ ID NO:196;
    (h) a polypeptide capable of beta 1,3 glycosylation of the C3' of the 13-O-glucose, 19-O-glucose, or both 13-O-glucose and 19-O-glucose of a steviol glycoside;
        wherein the polypeptide comprises a polypeptide having at least 95% sequence identity to the amino acid sequence set forth in SEQ ID NO: 200;
    (i) a polypeptide capable of glycosylating steviol or a steviol glycoside at its C-19 carboxyl group;
        wherein the polypeptide comprises a polypeptide having at least 95% sequence identity to the amino acid sequence set forth in SEQ ID NO:198; and/or
    (j) a polypeptide capable of beta 1,2 glycosylation of the C2' of the 13-O-glucose, 19-O-glucose, or both 13-O-glucose and 19-O-glucose of a steviol glycoside;
        wherein the polypeptide comprises a polypeptide having at least 95% sequence identity to the amino acid sequence set forth in SEQ ID NO:204.

7. The host cell of claim 1, wherein the bacterial cell comprises *Escherichia* bacteria cells, *Lactobacillus* bacteria cells, *Lactococcus* bacteria cells, *Corneberbacterium* bacteria cells, *Acetobacter* bacteria cells, *Acinetobacter* bacteria cells, or *Pseudomonas* bacterial cells.

8. The host cell of claim 1, wherein the fungal cell is a yeast cell.

9. The host cell of claim 8, wherein the yeast cell is a cell from *Saccharomyces cerevisiae*, *Schizosaccharomyces pombe*, *Yarrowia lipolytica*, *Candida glabrata*, *Ashbya gossypii*, *Cyberlindnera jadinii*, *Pichia pastoris*, *Kluyveromyces lactis*, *Hansenula polymorpha*, *Candida boidinii*, *Arxula adeninivorans*, *Xanthophyllomyces dendrorhous*, or *Candida albicans* species.

10. The host cell of claim 5, wherein the host cell excretes a decreased amount of steviol-13-O-glucoside (13-SMG) relative to a steviol glycoside-producing host cell that does not have the deletion of the one or more genes encoding the one or more transporter polypeptides.

11. The host cell of claim 5, wherein the host cell excretes an increased amount of RebA, RebB, RebD, and/or RebM relative to a steviol glycoside-producing host cell that does not have the deletion of the one or more genes encoding the one or more transporter polypeptides.

12. The host cell of claim 5, wherein the host cell produces an increased amount of RebA, RebB, RebD, and/or RebM relative to a steviol glycoside-producing host cell that does not have the deletion of the one or more genes encoding the one or more transporter polypeptides.

13. A method of increasing production of a steviol glycoside in a recombinant host cell or increasing excretion of a steviol glycoside into a culture medium, comprising culturing the host cell of claim 1 in a cell culture, under conditions in which one or more of the genes are expressed;
    wherein the steviol glycoside is produced by the host cell.

14. The method of claim 13, wherein the steviol glycoside is RebA, RebB, RebD, and/or RebM.

15. A method of increasing an amount of RebA, RebB, RebD, and/or RebM produced by a recombinant host cell, comprising culturing the host cell of claim 1 in a cell culture;
    wherein excretion of 13-SMG from the host cell into the cell culture is decreased relative to RebA, RebB, RebD, and/or RebM-producing host cell that does not have the deletion of the one or more genes encoding the one or more transporter polypeptides;

wherein RebA, RebB, RebD, and/or RebM are produced by the host cell.

16. The method of claim 13, that further comprises isolating RebA, RebB, RebD, and/or RebM, alone or in combination from the cell culture.

17. The method of claim 16, wherein the isolating step comprises separating a liquid phase of the cell culture from a solid phase of the cell culture to obtain a supernatant comprising RebA, RebB, RebD, and/or RebM, alone or in combination, and:
   (a) contacting the supernatant with one or more adsorbent resins in order to obtain at least a portion of RebA, RebB, RebD, and/or RebM, alone or in combination; or
   (b) contacting the supernatant with one or more ion exchange or reversed-phase chromatography columns in order to obtain at least a portion of RebA, RebB, RebD, and/or RebM, alone or in combination; or
   (c) crystallizing or extracting RebA, RebB, RebD, and/or RebM, alone or in combination;
thereby isolating RebA, RebB, RebD, and/or RebM, alone or in combination.

18. The method of claim 13, that further comprises recovering RebA, RebB, RebD, and/or RebM alone or a composition comprising RebA, RebB, RebD, and/or RebM from the cell culture.

19. The method of claim 18, wherein the recovered composition is enriched for RebA, RebB, RebD, and/or RebM, relative to a steviol glycoside composition of *Stevia* plant and has a reduced level of *Stevia* plant-derived components relative to a steviol glycoside composition obtained from a plant-derived *Stevia* extract.

20. The method of claim 13, wherein the cell culture comprises:
   (a) RebA, RebB, RebD, and/or RebM produced by the host cell of claim 1,
   (b) glucose, fructose, sucrose, xylose, rhamnose, uridine diphosphate (UDP)-glucose, UDP-rhamnose, UDP-xylose, and/or N-acetyl-glucosamine; and
   (c) supplemental nutrients comprising trace metals, vitamins, salts, yeast nitrogen base (YNB), and/or amino acids.

21. A cell culture, comprising the host cell of claim 1, the cell culture further comprising:
   (a) RebA, RebB, RebD, and/or RebM produced by the host cell;
   (b) glucose, fructose, sucrose, xylose, rhamnose, uridine diphosphate (UDP)-glucose, UDP-rhamnose, UDP-xylose, and/or N-acetyl-glucosamine; and
   (c) supplemental nutrients comprising trace metals, vitamins, salts, YNB, and/or amino acids;
wherein RebA, RebB, RebD, and/or RebM are present at a concentration of at least 1 mg/liter of the cell culture.

22. A cell lysate, comprising RebA, RebB, RebD, and/or RebM produced by the host cell of claim 1, and the cell lysate further comprising glucose, fructose, sucrose, xylose, rhamnose, uridine diphosphate (UDP)-glucose, UDP-rhamnose, UDP-xylose, and/or N-acetyl-glucosamine, supplemental nutrients comprising trace metals, vitamins, salts, YNB, and/or amino acids.

23. The host cell of claim 1, wherein the host cell is a *Yarrowia lipolytica* cell.

24. The method of claim 13, wherein:
   (a) Reb A is produced in the recombinant host cell expressing the polypeptide capable of glycosylating steviol or a steviol glycoside at its C-13 hydroxyl group; the polypeptide capable of beta 1,3 glycosylation of the C3' of the 13-O-glucose, 19-O-glucose, or both 13-O-glucose and 19-0-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside;
   (b) Reb B is produced in the recombinant host cell expressing the polypeptide capable of glycosylating steviol or a steviol glycoside at its C-13 hydroxyl group; the polypeptide capable of beta 1,3 glycosylation of the C3' of the 13-O-glucose, 19-O-glucose, or both 13-O-glucose and 19-0-glucose of a steviol glycoside; and the polypeptide capable of beta 1,2 glycosylation of the C2' of the 13-O-glucose, 19-O-glucose, or both 13-O-glucose and 19-O-glucose of a steviol glycoside;
   (c) Reb D is produced in the recombinant host cell expressing the polypeptide capable of glycosylating steviol or the steviol glycoside at its C-13 hydroxyl group; the polypeptide capable of beta 1,3 glycosylation of the C3' of the 13-O-glucose, 19-O-glucose, or both 13-O-glucose and 19-0-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside; and/or
   (d) Reb M is produced in the recombinant host cell expressing the polypeptide capable of glycosylation of the 13-OH of steviol; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside.

25. The method of claim 13, wherein Reb A is produced in the recombinant host cell expressing the polypeptide capable of glycosylating steviol or a steviol glycoside at its C-13 hydroxyl group; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside.

26. The method of claim 13, wherein Reb D is produced in the recombinant host cell expressing the polypeptide capable of glycosylating steviol or the steviol glycoside at its C-13 hydroxyl group; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside.

27. The method of claim 13, wherein Reb M is produced in the recombinant host cell expressing the polypeptide capable of glycosylation of the 13-OH of steviol; the polypeptide capable of beta 1,3 glycosylation of the C3' of the 13-O-glucose, 19-O-glucose, or both 13-O-glucose and 19-O-glucose of a steviol glycoside; the polypeptide capable of glycosylating steviol or a steviol glycoside at its C-19 carboxyl group; and the polypeptide capable of beta 1,2 glycosylation of the C2' of the 13-O-glucose, 19-O-glucose, or both 13-O-glucose and 19-O-glucose of a steviol glycoside.

28. The recombinant host of claim 1, wherein the steviol glycoside is Rebaudioside A (Reb A), Rebaudioside B (Reb B), Reb D and/or Reb M or an isomer thereof.

* * * * *